US011318197B2

(12) United States Patent
Haynes et al.

(10) Patent No.: US 11,318,197 B2
(45) Date of Patent: May 3, 2022

(54) COMPOSITIONS AND METHODS FOR INDUCING HIV-1 ANTIBODIES

(71) Applicant: Duke University, Durham, NC (US)

(72) Inventors: Barton F. Haynes, Durham, NC (US); Kevin O. Saunders, Durham, NC (US)

(73) Assignee: DUKE UNIVERSITY, Durham, NC (US)

( * ) Notice: Subject to any disclaimer, the term of this patent is extended or adjusted under 35 U.S.C. 154(b) by 0 days.

(21) Appl. No.: 16/489,245

(22) PCT Filed: Mar. 2, 2018

(86) PCT No.: PCT/US2018/020788
§ 371 (c)(1),
(2) Date: Aug. 27, 2019

(87) PCT Pub. No.: WO2018/161049
PCT Pub. Date: Sep. 7, 2018

(65) Prior Publication Data

US 2020/0113997 A1 Apr. 16, 2020

Related U.S. Application Data

(63) Continuation-in-part of application No. PCT/US2017/020823, filed on Mar. 3, 2017.

(60) Provisional application No. 62/624,620, filed on Jan. 31, 2018, provisional application No. 62/403,649, filed on Oct. 3, 2016, provisional application No. 62/303,273, filed on Mar. 3, 2016.

(51) Int. Cl.

| | |
|---|---|
| ***A61K 39/21*** | (2006.01) |
| ***A61K 39/00*** | (2006.01) |
| ***A61K 39/12*** | (2006.01) |
| ***C07K 14/005*** | (2006.01) |
| ***C12N 7/00*** | (2006.01) |
| ***A61P 31/18*** | (2006.01) |
| ***A61K 39/39*** | (2006.01) |

(52) U.S. Cl.
CPC .............. *A61K 39/21* (2013.01); *A61K 39/39* (2013.01); *A61P 31/18* (2018.01); *C07K 14/005* (2013.01); *C12N 7/00* (2013.01); *A61K 2039/55555* (2013.01); *C12N 2740/16122* (2013.01); *C12N 2740/16134* (2013.01); *C12N 2740/16171* (2013.01)

(58) Field of Classification Search
CPC ...... C07K 14/005; A61K 39/12; A61K 39/21; C12N 2740/16122; C12N 2740/16134
See application file for complete search history.

(56) References Cited

U.S. PATENT DOCUMENTS

| | | | |
|---|---|---|---|
| 5,792,459 | A | 8/1998 | Haigwood |
| 7,951,377 | B2 | 5/2011 | Korber et al. |
| 8,071,107 | B2 | 12/2011 | Haynes et al. |
| 9,872,900 | B2 | 1/2018 | Ciaramella et al. |
| 2003/0147888 | A1 | 8/2003 | Haynes et al. |
| 2006/0051373 | A1 | 3/2006 | Olson et al. |
| 2009/0286852 | A1 | 11/2009 | Kariko et al. |
| 2010/0015218 | A1 | 1/2010 | Jadhav et al. |
| 2010/0041875 | A1 | 2/2010 | Dey et al. |
| 2011/0076298 | A1 | 3/2011 | Olson et al. |
| 2011/0250220 | A1 | 10/2011 | Dey et al. |
| 2011/0262488 | A1 | 10/2011 | Phogat et al. |
| 2012/0052090 | A1 | 3/2012 | Tamamura et al. |
| 2013/0111615 | A1 | 5/2013 | Kariko et al. |
| 2013/0197068 | A1 | 8/2013 | Kariko et al. |
| 2013/0261172 | A1 | 10/2013 | Kariko et al. |
| 2014/0328862 | A1 | 11/2014 | Scheid et al. |
| 2015/0038558 | A1 | 2/2015 | Kariko et al. |
| 2016/0032316 | A1 | 2/2016 | Weissman et al. |
| 2016/0271244 | A1 | 9/2016 | Haynes et al. |
| 2017/0043037 | A1 | 2/2017 | Kariko et al. |
| 2017/0233441 | A1 | 8/2017 | Kwong et al. |
| 2017/0327842 | A1 | 11/2017 | Weissman et al. |
| 2017/0369532 | A1 | 12/2017 | Carfi et al. |
| 2018/0028645 | A1 | 2/2018 | Ciaramella et al. |
| 2018/0072777 | A1 | 3/2018 | Rutten et al. |

FOREIGN PATENT DOCUMENTS

| | | | |
|---|---|---|---|
| CA | 2944068 | A1 | 10/2015 |
| EP | 0272858 | A2 | 6/1988 |
| EP | 1466924 | A1 | 10/2004 |
| EP | 1738764 | A1 | 1/2007 |
| WO | WO-07/149491 | A2 | 12/2007 |
| WO | WO-10/031113 | A1 | 3/2010 |
| WO | WO-2013/006688 | A2 | 1/2013 |
| WO | WO-14/42669 | A1 | 3/2014 |
| WO | WO-14/043386 | A1 | 3/2014 |
| WO | WO-2014/172366 | A1 | 10/2014 |
| WO | WO-2015/127108 | A1 | 8/2015 |
| WO | WO-2015/153638 | A1 | 10/2015 |
| WO | WO-16/037154 | A1 | 3/2016 |

(Continued)

OTHER PUBLICATIONS

"FASTX-Toolkit", downloaded from http://hannonlab.cshl.edu/fastx_toolkit, last retrieved Nov. 4, 2020 (2 total pages).

(Continued)

*Primary Examiner* — Barry A Chestnut

(74) *Attorney, Agent, or Firm* — Wilmer Cutler Pickering Hale and Dorr LLP

(57) ABSTRACT

In certain aspects the invention provides HV-1 immunogens, including envelopes (CH0848) and selections therefrom, and methods for swarm immunizations using combinations of HIV-1 envelopes.

31 Claims, 207 Drawing Sheets

Specification includes a Sequence Listing.

(56) References Cited

FOREIGN PATENT DOCUMENTS

| | | | |
|---|---|---|---|
| WO | WO-2016/149695 | A1 | 9/2016 |
| WO | WO-17/151801 | A1 | 9/2017 |
| WO | WO-17/0152146 | A2 | 9/2017 |
| WO | WO-18/067580 | A1 | 4/2018 |
| WO | WO-18/161049 | A1 | 9/2018 |
| WO | WO-19/169356 | A1 | 9/2019 |
| WO | WO-20/72162 | A1 | 4/2020 |
| WO | WO-20/72169 | A1 | 4/2020 |

OTHER PUBLICATIONS

"Models of SHM Targeting and Substitution—SF5 Mutability Model dataset" last downloaded Feb. 2, 2021 from; http://clip.med.yale.edu/shm/download.php (2 total pages).

Alam, S. M., et al., "Antigenicity and Immunogenicity of RV144 Vaccine AIDSVAX Clade E Envelope Immunogen Is Enhanced by a gp120 N-Terminal Deletion," Journal of Virology, vol. 87, No. 3, pp. 1554-1568 (Feb. 2013).

Alam, S.M., et al., "Human Immunodeficiency Virus Type 1 gp41 Antibodies That Mask Membrane Proximal Region Epitopes: Antibody Binding Kinetics, Induction, and Potential for Regulation in Acute Infection," J. Virol., vol. 82, No. 1, pp. 115-125 (Jan. 2008).

Alam, S.M., et al., "Mimicry of an HIV broadly neutralizing antibody epitope with a synthetic glycopeptide," Sci. Transl. Med., vol. 9, No. 381, eaai7521 Mar. 15, 2017 (Author Manuscript—20 total pages—available in PMC Aug. 18, 2017).

Alam, S.M., et al., "Recognition of synthetic glycopeptides by HIV-1 broadly neutralizing antibodies and their unmutated ancestors," PNAS, vol. 110, No. 45, pp. 18214-18219 (Nov. 5, 2013)—last downloaded Oct. 6, 2020 from https://www.pnas.org/content/110/45/18214 (24 total pages).

Alam, S.M., et al., "The Role of Antibody Polyspecificity and Lipid Reactivity in Binding of Broadly Neutralizing Anti-HIV-1 Envelope Human Monoclonal Antibodies 2F5 and 4E10 to Glycoprotein 41 Membrane Proximal Envelope Epitopes," J. Immunol., vol. 178, pp. 4424-4435 (accepted for publication Jan. 12, 2007) (13 total pages).

Alam, S. M., et al., "Role of HIV membrane in neutralization by two broadly neutralizing antibodies", PNAS, vol. 106, No. 48, pp. 20234-20239 (Dec. 1, 2009).

Alving, C.R., et al., "Adjuvants for human vaccines," Current Opinion in Immunology, vol. 24, No. 3, pp. 310-315 (Jun. 2012), Author Manuscript available in PMC Jun. 1, 2013—12 total pages.

Andrabi, R., et al., "Identification of Common Features in Prototype Broadly Neutralizing Antibodies to HIV Envelope V2 Apex to Facilitate Vaccine Design," Immunity, vol. 43, No. 5, pp. 959-973 (Nov. 2015)—Author Manuscript available in PMC Nov. 17, 2016 (25 total pages).

Arnaoty, A., et al., "Novel Approach for the Development of New Antibodies Directed Against Transposase-Derived Proteins Encoded by Human Neogenes," Yves Bigot (ed.), Mobile Genetic Elements: Protocols and Genomic Applications, Methods in Molecular Biology, vol. 859, Chapter 17, pp. 293-305 (2012).

Arnaoty, Ahmed, et al., "Reliability of the nanopheres-DNA immunization technology to produce polyclonal antibodies directed against human neogenic proteins," Mol. Genet. Genomics, vol. 288, pp. 347-363 (2013).

Aussedat, B., et al., "Chemical synthesis of highly congested gp120 V1V2 N-glycopeptide antigens for potential HIV-1-directed vaccines," J. Am. Chem. Soc., vol. 135, No. 35, Sep. 2013 (Author Manuscript—16 total pages—available in PMC Sep. 4, 2014).

Bamrungsap, S. et al., "Nanotechnology in therapeutics: a focus on nanoparticles as a drug delivery system," Nanomedicine, vol. 7, No. 8, pp. 1253-1271 (2012).

Barouch, D. H., et al., "Mosaic HIV-1 Vaccines Expand the Breadth and Depth of Cellular Immune Responses in Rhesus Monkeys," Nature Medicine, vol. 16, No. 3, pp. 319-323, Mar. 2010 (Author Manuscript—15 total pages—available in PMC Sep. 1, 2010).

Batista, F.D., et al., "B cells extract and present immobilized antigen: implications for affinity discrimination," The EMBO Journal, vol. 19, No. 4, pp. 513-520 (2000).

Behrens, A.J., et al. "Composition and Antigenic Effects of Individual Glycan Sites of a Trimeric HIV-1 Envelope Glycoprotein," Cell Rep. vol. 14, pp. 2695-2706 with cover page—13 total pages (Mar. 22, 2016).

Betz, A G., "Passenger transgenes reveal intrinsic specificity of the antibody hypermutation mechanism: Clustering, polarity, and specific hot spots," Proceedings of the National Academy of Sciences of the United States of America, vol. 90, pp. 2385-2388 (Mar. 1993).

Bhattacharya, T., et al., "Founder Effects in the Assessment of HIV Polymorphisms and HLA Allele Associations," Science, vol. 315, No. 5818, pp. 1583-1586, Apr. 2007 (last downloaded Oct. 6, 2020 from https://www.researchgate.net/publication/6442933_Founder_Effects_in_the_Assessment_of_HIV _Polymorphisms_and_HLA_Allele_Associations—10 total pages).

Binley, J.M., et al., "Enhancing the Proteolytic Maturation of Human Immunodeficiency Virus Type 1 Envelope Glycoproteins," Journal of Virology, vol. 76, No. 6, pp. 2606-2616 (Mar. 2002).

Bonsignori, M., et al. "Staged induction of HIV-1 glycan-dependent broadly neutralizing antibodies" Sci Transl Med., vol. 9, No. 381, Mar. 15, 2017—(Author Manuscript available in PMC Aug. 18, 2017—26 total pages).

Bonsignori, M., et al., "Analysis of a Clonal Lineage of HIV-1 Envelope V2/V3 Conformational Epitope-Specific Broadly Neutralizing Antibodies and Their Inferred Unmutated Common Ancestors," Journal of Virology, vol. 85, No. 19, pp. 9998-10009 (Oct. 2011).

Bonsignori, M., et al., "Maturation Pathway from Germline to Broad HIV-1 Neutralizer of a CD4-Mimic Antibody," Cell, vol. 165, pp. 449-463 with cover page—16 total pages (Apr. 7, 2016).

Bonsignori, M., et al., "Two distinct broadly neutralizing antibody specificities of different clonal lineages in a single HIV-1-infected donor: implications for vaccine design," Journal of Virology, vol. 86, No. 8, pp. 4688-4692 (published online Feb. 1, 2012).

Bosch, V., et al., "Mutational Analysis of the Human Immunodeficiency Virus Type 1 env Gene Product Proteolytic Cleavage Site," Journal of Virology, vol. 64, No. 5, pp. 2337-2344 (May 1990).

Bransteitter, R., et al., "Biochemical analysis of Hypermutational Targeting by Wild Type and Mutant Activation-induced Cytidine Deaminase," The Journal of Biological Chemistry, vol. 279, No. 49, pp. 51612-51621 (with cover page—11 pages total (Sep. 14, 2004).

Burton D. R. , "Antibody responses to envelope glycoproteins in HIV-1 infection," Nature immunology, vol. 16, No. 6, pp. 571-576, Jun. 2015 (Author Manuscript—17 total pages—available in PMC Apr. 18, 2016).

Burton, D.R., et al. "Broadly Neutralizing Antibodies to HIV and Their Role in Vaccine Design," Annu Rev Immunol, vol. 34, pp. 635-659, May 2016 (Author Manuscript—31 total pages—available in PMC Jul. 6, 2018).

Cany, J., et al., "AFP-specific immunotherapy impairs growth of autochthonous hepatocellular carcinoma in mice," Journal of Hepatology, vol. 54, pp. 115-121 (2011).

Center, R.J., et al., "Oligomeric structure of the human immunodeficiency virus type 1 envelope protein on the virion surface," Journal of Virology, vol. 76, No. 15, pp. 7863-7867 (Aug. 2002).

Chakrabarti, B.K., et al., "Modifications of the Human Immunodeficiency Virus Envelope Glycoprotein Enhance Immunogenicity for Genetic Immunization," Journal of Virology, vol. 76, No. 11, pp. 5357-5368 (Jun. 2002).

Churchyard, G.J., et al, A Phase IIA Randomized Clinical Trial of a Multiclade HIV-1 DNA Prime Followed by a Multiclade rAd5 HIV-1 Vaccine Boost in Healthy Adults (HVTN204), PLoS One, vol. 6, No. 8, e21225, Aug. 2011 (last downloaded on Jan. 19, 2021 from https://journals.plos.org/plosone/article?id=10.1371 /journal.pone.0021225—10 total pages).

Cloanalyst Software, Boston University—Microbiology, Laboratory of Computational Immunology, downloaded from http://www.bu.edu/computationalimmunology/research/software (3 total pages) last retrieved Oct. 5, 2020.

Cowell, L. G. and Kepler, T.B., "The nucleotide-replacement spectrum under somatic hypermutation exhibits microsequence depen-

(56) References Cited

OTHER PUBLICATIONS dence that is strand-symmetric and distinct from that under germline mutation," Journal of Immunology, vol. 164, pp. 1971-1976 (2000).
De Taeye, S. W., et al., "Immunogenicity of stabilized HIV-1 envelope trimers with reduced exposure of non-neutralizing epitopes," Cell., vol. 163, No. 7, pp. 1702-1715, Dec. 17, 2015 (Author Manuscript—25 total pages—available in PMC Jan. 29, 2016).
DeCamp, A., et al. "Global panel of HIV-1 Env reference strains for standardized assessments of vaccine-elicited neutralizing antibodies," J Virol, vol. 88, No. 5,pp. 2489-2507 (Mar. 2014).
Dennison, S.M., et al., "Induction of Antibodies in Rhesus Macaques That Recognize a Fusion-Intermediate Conformation of HIV-1 gp41," Public Library of Science ONE, vol. 6, No. 11, e27824, pp. 1-14 (Nov. 30, 2011).
Dennison, S.M., et al., "Nonneutralizing HIV-1 gp4 I envelope cluster II human monoclonal antibodies show polyreactivity for binding to phospholipids and protein autoantigens," J. Virol. vol. 85, No. 3, pp. 1340-1347 (Feb. 2011).
Dennison, S.M., et al., "Stable Docking of Neutralizing Human Immunodeficiency Virus Type 1 gp41 Membrane-Proximal External Region Monoclonal Antibodies 2F5 and 4E10 Is Dependent on the Membrane Immersion Depth of Their Epitope Regions," Journal of Virology, vol. 83, No. 19, pp. 10211-10223 (Oct. 2009).
Di Noia, J.M.,et al., "Molecular mechanisms of antibody somatic hypermutation," Annu Rev Biochem, vol. 76, pp. 1-22 including TOC—25 total pages (published online Feb. 28, 2007).
Doores, K. J., et al., "Two Classes of Broadly Neutralizing Antibodies within a Single Lineage Directed to the High-Mannose Patch of HIV Envelope," Journal of Virology, vol. 89, No. 2, pp. 1105-1118 (Jan. 2015) with Author Correction, Journal of Virology, vol. 89, No. 12, p. 6525, Jun. 2015).
Doria-Rose, N.A., et al., "Developmental pathway for potent V1V2-directed HIV-neutralizing antibodies," Nature, vol. 509, No. 7498, pp. 55-62 (published online Mar. 2, 2014)—Author Manuscript—33 total pages (available in PMC Apr. 13, 2015).
Easterhoff, D., et al. "Boosting of HIV envelope CD4 binding site antibodies with long variable heavy third complementarity determining region in the randomized double blind RV305 HIV-1 vaccine trial," PLoS Pathogens, vol. 13, No. 2, e1006182, pp. 1-21 (Feb. 24, 2017).
Eroshkin, A.M., et al., "bNAber: database of broadly neutralizing HIV antibodies," Nucleic Acids Res, vol. 42, pp. D1133-D1139 (published online Nov. 7, 2013).
Fera, D. and Harrison, S.C., "92BR SOSIP.664 trimer in complex with DH270.1 Fab," EM Data Bank Accession No. EMD-8507 downloaded from EMDataResource https://www.emdataresource.org/EMD-8507 (6 total pages) last retrieved Nov. 3, 2020.
Fera, D., et al., "Affinity maturation in an HIV broadly neutralizing B-cell lineage through reorientation of variable domains," Proceedings of the National Academy of Sciences of the United States of America, vol. 111, No. 28, pp. 10275-10280 (Jul. 15, 2014).
Gao, F. et al., "Antigenicity and Immunogenicity of a Synthetic Human Immunodeficiency Virus Type 1 Group M Consensus Envelope Glycoprotein," Journal of Virology, vol. 79, No. 2, pp. 1154-1163 (Jan. 2005).
Gao, F., et al., "Cooperation of B Cell Lineages in Induction of HIV-1-Broadly Neutralizing Antibodies," Cell, vol. 158, pp. 481-491 (Jul. 31, 2014).
Garces, F., et al., "Affinity maturation of a potent family of HIV antibodies is primarily focused on accommodating or avoiding glycans," Immunity, vol. 43, No. 6, pp. 1053-1063, Dec. 2015 (Author Manuscript—22 total pages—available in PMC Dec. 15, 2016).
Garces, F., et al., "Structural evolution of glycan recognition by a family of potent HIV antibodies," Cell, vol. 159, No. 1, pp. 69-79, Sep. 2014 (Author Manuscript—23 total pages—available in PMC Sep. 25, 2015).
GenBank with accession Nos. KY347498 through KY347701 downloaded from https://www.ncbi.nlm.nih.gov/ last retrieved on Nov. 4, 2020 (22 total pages).
GenBank with accession Nos. KY354938 through KY354963 downloaded from https://www.ncbi.nlm.nih.gov/ last retrieved on Nov. 4, 2020 (3 total pages).
Georgiev, I.S., et al., "Antibodies VRC01 and 10E8 neutralize HIV-1 with high breadth and potency even with Ig-framework regions substantially reverted to germline," Journal of Immunology, vol. 192, pp. 1100-1106 with cover page—8 total pages (published online Jan. 3, 2014).
Gnanakaran, S., et al., "Genetic Signatures in the Envelope Glycoproteins of HIV-1 that Associate with Broadly Neutralizing Antibodies," PLoS Computational Biology, vol. 6, No. 10, e1000955, 24 total pages (published Oct. 7, 2010).
Go, E.P., et al., "Comparative Analysis of the Glycosylation Profiles of Membrane-Anchored HIV-1 Envelope Glycoprotein Trimers and Soluble gp140," Journal of Virology, vol. 89, No. 16, pp. 8245-8257 (Aug. 2015).
Goo, L., et al., "Early development of broadly neutralizing antibodies in HIV-I-infected infants," Nature Medicine, vol. 20, No. 6, pp. 655-658, (Jun. 2014), Author Manuscript—available in PMC Dec. 1, 2014 (14 total pages).
Gorman, J., et al., "Structures of HIV-1 Env V1V2 with broadly neutralizing antibodies reveal commonalities that enable vaccine design," Nature Structural and Molecular Biology, vol. 23, No. 1, pp. 81-90 (Jan. 2016)—Author Manuscript (34 total pages)—available in PMC Jun. 21, 2016).
Graham, B.S., et al., "DNA Vaccine Delivered by a Needle-Free Injection Device Improves Potency of Priming for Antibody and CD8+ T-Cell Responses after rAd5 Boost in a Randomized Clinical Trial," Public Library of Science ONE, vol. 8, No. 4, e59340, pp. 1-11 (Apr. 8, 2013).
Gray, E.S., et al. "Isolation of a Monoclonal Antibody That Targets the Alpha-2 Helix of gp120 and Represents the Initial Autologous Neutralizing-Antibody Response in an HIV-1 Subtype C-Infected Individual," Journal of Virology, vol. 85, No. 15, pp. 7719-7729 (Aug. 2011).
Gray, E. S., et al., "The Neutralization Breadth of HIV-1 Develops Incrementally over Four Years and Is Associated with CD4+ T Cell Decline and High Viral Load during Acute Infection," Journal of Virology, vol. 85, No. 10, pp. 4828-4840 (May 2011).
Guo, H.-G., et al., "Characterization of an HIV-1 Point Mutant Blocked in Envelope Glycoprotein Cleavage," Virology, vol. 174, pp. 217-224 (1990).
Guttman, M., et al., "Antibody potency relates to the ability to recognize the closed, pre-fusion form of HIV Env," Nature Communications, vol. 6, No. 6144, pp. 1-11 (Feb. 5, 2015).
Haynes, B. F., et al., "B-cell-lineage immunogen design in vaccine development with HIV-1 as a case study," Nat. Biotechnol., vol. 30, No. 5, pp. 423-433 (2012)—Author Manuscript available in PMC May 7, 2013 (30 total pages).
Haynes, B.F., et al., "Developing an HIV vaccine," Science, vol. 355, No. 6330, pp. 1129-1130, (Mar. 17, 2017)—Author Manuscript available in PMC Mar. 17, 2018—(5 total pages).
He, L., et al., "Presenting native-like trimeric HIV-1 antigens with self-assembling nanoparticles," Nature Communications, vol. 7, No. 12041, pp. 1-15 (Jun. 28, 2016).
Hraber, P., et al., "Prevalence of broadly neutralizing antibody responses during chronic HIV-1 infection," AIDS, vol. 28, No. 2, pp. 163-169 (Jan. 14, 2014), Author Manuscript available in PMC Jan. 14, 2015 (13 total pages).
Hraber, P., et al., "Longitudinal Antigenic Sequences and Sites from Intra-Host Evolution (LASSIE) Identifies Immune-Selected HIV Variants," Viruses, vol. 7, pp. 5443-5475 (Oct. 21, 2015).
Hwang, J.K., et al., "Sequence Intrinsic Somatic Mutation Mechanisms Contribute to Affinity Maturation of VRC01-class HIV-1 Broadly Neutralizing Antibodies," Proceedings of the National Academy of Sciences of the United States of America, vol. 114, No. 32, pp. 8614-8619 (Aug. 8, 2017).
International Search Report and Written Opinion dated Aug. 23, 2017 by U.S. Patent and Trademark Office as International Searching Authority for International Patent Application No. PCT/US2017/020823 (15 total pages).

(56) References Cited

OTHER PUBLICATIONS

International Search Report and Written Opinion dated Feb. 1, 2018 by U.S. Patent and Trademark Office as International Searching Authority for International Patent Application No. PCT/US2017/054956 (14 total pages).

Jardine, J.G., et al., "Minimally Mutated HIV-1 Broadly Neutralizing Antibodies to Guide Reductionist Vaccine Design," PLOS Pathogens, vol. 12, No. 8, e1005815, pp. 1-33 (Aug. 25, 2016).

Julien, J.-P., et al., "Broadly Neutralizing Antibody PGT121 Allosterically Modulates CD4 Binding via Recognition of the HIV-1 gp120 V3 Base and Multiple Surrounding Glycans," Public Library of Science Pathogens, vol. 9, No. 5: e1003342, pp. 1-15 (May 2, 2013).

Keele, B. F., et al., "Identification and characterization of transmitted and early founder virus envelopes in primary HIV-1 infection," Proceedings of the National Academy of Sciences of the United States of America, vol. 105, No. 21, pp. 7552-7557 (May 27, 2008).

Kelsoe, G., et al., "Host controls of HIV broadly neutralizing antibody development," Immunology Review, vol. 275, No. 1, pp. 79-88 (Jan. 2017), Author Manuscript—19 total pages—available in PMC Jun. 21, 2017.

Kepler, T.B., "Reconstructing a B-cell clonal lineage. I. Statistical inference of unobserved ancestors," F1000 Research 2013, vol. 2, No. 103, 12 total pages (last updated Jan. 22, 2014).

Kepler, T.B., et al., "Immunoglobulin gene insertions and deletions in the affinity maturation of HIV-1 broadly reactive neutralizing antibodies," Cell Host & Microbe, vol. 16, pp. 304-313 (Sep. 10, 2014).

Kepler, T.B., et al., "Reconstructing a B-Cell Clonal Lineage. II. Mutation, Selection, and Affinity Maturation," Frontiers in Immunology, vol. 5, Article 170, pp. 1-10 (Apr. 2014).

Kibler, K. V., et al., "Improved NYVAC-based vaccine vectors," Public Library of Science ONE, vol. 6, No. 11: e25674, pp. 1-13, (Nov. 9, 2011).

Kirchherr, J. L., et al., "High throughput functional analysis of HIV-1 env genes without cloning," Journal of Virological Methods, vol. 143, No. 1, pp. 104-111, Jul. 2007 (Author Manuscript—18 total pages—available in PMC Jul. 1, 2008).

Klein, F., et al., "Somatic Mutations of the Immunoglobulin Framework Are Generally Required for Broad and Potent HIV-1 Neutralization", Cell, vol. 153, pp. 126-138 (Mar. 28, 2013).

Kong, L., et al., "Complete epitopes for vaccine design derived from a crystal structure of the broadly neutralizing antibodies PGT128 and 8ANC195 in complex with an HIV-1 Env trimer," Acta Crystallographica, Section D, Biological Crystallography, vol. D71, pp. 2099-2108 (2015).

Kong, L., et al., "Supersite of immune vulnerability on the glycosylated face of HIV-1 envelope glycoprotein gp120," Nature Structural Molecular Biology, vol. 20, No. 7, pp. 796-803, Jul. 2013 (Author Manuscript—22 total pages—available in PMC Jan. 1, 2014).

Kwon, Y.-D., et al., "Crystal structure, conformational fixation, and entry-related interactions of mature ligand-free HIV-1 Env," Nature Structural Molecular Biology, vol. 22, No. 7, pp. 522-531, Jul. 2015 (Author Manuscript—30 total pages—available in PMC Jan. 8, 2016).

Lee, J. H., et al., "Model Building and Refinement of a Natively Glycosylated HIV-1 Env Protein by High-Resolution Cryoelectron Microscopy," Structure, vol. 23, pp. 1943-1951 with cover page 10 total pages—(Oct. 6, 2015).

Li, M., et al., "Human Immunodeficiency Virus Type 1 env Clones from Acute and Early Subtype B Infections for Standardized Assessments of Vaccine-Elicited Neutralizing Antibodies," J. Virol., vol. 79, No. 16, pp. 10108-10125 (Aug. 2005).

Li, Y., et al., "Control of expression, glycosylation, and secretion of HIV-1 gp120 by homologous and heterologous signal sequences," Virology, vol. 204, pp. 266-278 (accepted Jun. 23, 1994).

Li, Y., et al., "Effects of inefficient cleavage of the signal sequence of HIV-1 gp120 on its association with calnexin, folding, and intracellular transport," Proceedings of the National Academy of Sciences of the United States of America, vol. 93, pp. 9606-9611 (Sep. 1996).

Liao, H.-X., et al., "A group M consensus envelope glycoprotein induces antibodies that neutralize subsets of subtype B and C HIV-1 primary viruses," Virology, vol. 353, pp. 268-282 (available online Jul. 7, 2006).

Liao, H.X., et al., "Antigenicity and Immunogenicity of Transmitted/Founder, Consensus, and Chronic Envelope Glycoproteins of Human Immunodeficiency Virus Type 1," Journal of Virology, vol. 87, No. 8, pp. 4185-4201 with Supplementary Materials—34 total pages (Apr. 2013).

Liao, H.X., et al., "Co-evolution of a broadly neutralizing HIV-1 antibody and founder virus," Nature, vol. 496, No. 7446, pp. 469-476, Apr. 25, 2013 (Author Manuscript—25 total pages—available in PMC Oct. 25, 2013).

Liao, H.X., et al., "Vaccine induction of antibodies against a structurally heterogeneous site of immune pressure within HIV-1 envelope protein variable regions 1 and 2," Immunity, vol. 38, No. 1, pp. 176-186, Jan. 24, 2013 (Author Manuscript—21 total pages—available in PMC Jan. 24, 2014).

Loughran, G., et al., "Evidence of efficient stop codon readthrough in four mammalian genes," Nucleic Acids Research, vol. 42, No. 14, pp. 8928-8938 (published online Jul. 10, 2014).

Mascola, J. R. and Haynes, B.F., "HIV-1 neutralizing antibodies: understanding nature's pathways," Immunological Reviews, vol. 254, No. 1, pp. 225-244 Jul. 2013 (Author Manuscript—29 pages—available in PMC Jul. 1, 2014).

McCune, J.M., et al., "Endoproteolytic Cleavage of gp160 Is Required for the Activation of Human Immunodeficiency Virus," Cell, vol. 53, pp. 55-67 (Apr. 8, 1988).

McGuire, A.T., et al., "Engineering HIV envelope protein to activate germline B cell receptors of broadly neutralizing anti-CD4 binding site antibodies", The Journal of Experimental Medicine, vol. 210, No. 4, pp. 655-663 (Mar. 25, 2013).

Moody, M.A., et al., "Toll-Like Receptor 7 /8 (TLR7/8) and TLR9 Agonists Cooperate to Enhance HIV-1 Envelope Antibody Responses in Rhesus Macaques," J. Virol., vol. 88, No. 6, pp. 3329-3339 (Mar. 2014).

Moore, P. L. et al., "Evolution of an HIV glycan-dependent broadly neutralizing antibody epitope through immune escape," Nat. Med. vol. 18, No. 11, pp. 1688-1692 (Nov. 2012)—Author Manuscript—12 total pages—available in PMC Nov. 9, 2012.

Mouquet, H., et al., "Complex-type N-glycan recognition by potent broadly neutralizing HIV antibodies," Proceedings of the National Academy of Sciences of the United States of America, pp. E3268-E3277, https://www.pnas.org/content/109/47/E3268 (published online Oct. 30, 2012).

Muenchhoff, M., et al., "Non-progressing HIV-infected children share fundamental immunological features of non-pathogenic SIV infection," Sci Transl Med, vol. 8, No. 358: ra125 (published Sep. 28, 2016), Author Manuscript—25 total pages (available Aug. 12, 2018).

Munro, J.B., et al., "Conformational dynamics of single HIV-1 envelope trimers on the surface of native virions," Science, vol. 346, Issue 6210, pp. 759-763, Nov. 7, 2014, with Supplementary Materials, pp. 1-27 and cover pages (34 total pages).

Neuberger, M.S., et al., "Monitoring and interpreting the intrinsic features of somatic hypermutation," Immunol. Rev., vol. 162, pp. 107-116 (1998).

Nickle D. C., et al., "HIV-Specific Probabilistic Models of Protein Evolution," PloS One, Issue 6, e503, pp. 1-11 (Jun. 2007).

Pancera, M., et al. "Structure and immune recognition of trimeric prefusion HIV-1 Env", Nature, vol. 514, No. 7523, pp. 455-461, Oct. 2014 (Author Manuscript—43 total pages—available in PMC Apr. 23, 2015).

Pancera, M., et al., "N332-Directed Broadly Neutralizing Antibodies Use Diverse Modes of HIV-1 recognition: Inferences from Heavy-Light Chain Complementation of Function," PloS One, vol. 8, No. 2, e55701, 11 total pages (published Feb. 19, 2013).

Parren, P.W.H.I., et al., "Antibody Neutralization-Resistant Primary Isolates of Human Immunodeficiency Virus Type 1," Journal of Virology, vol. 72, No. 12, pp. 10270-10274 (Dec. 1998).

Pejchal, R., et al., "A potent and broad neutralizing antibody recognizes and penetrates the HIV glycan shield," Science, vol. 334,

(56) References Cited

OTHER PUBLICATIONS

No. 6059, pp. 1097-1103, Oct. 2011 (Author Manuscript—13 total pages—available in PMC Nov. 25, 2012).
Perreau, M., et al., "DNA/NYVAC Vaccine Regimen Induces HIV-Specific CD4 and CD8 T-Cell Responses in Intestinal Mucosa," Journal of Virology, vol. 85, No. 19, pp. 9854-9862 (Oct. 2011).
Poignard, P., et al., "Heterogeneity of envelope molecules expressed on primary human immunodeficiency virus type 1 particles as probed by the binding of neutralizing and nonneutralizing antibodies.," Journal of Virology, vol. 77, No. 1, pp. 353-365 (Jan. 2003).
Proft, T., , "Sortase-mediated protein ligation: an emerging biotechnology tool for protein modification and immobilisation," Biotechnol. Lett., vol. 32, pp. 1-10 (published online Sep. 1, 2009).
Protein Data Bank (PDB) ID 4LST, downloaded from https://www.rcsb.org/structure/4LST, last retrieved Nov. 4, 2020 (7 total pages).
Protein Data Bank (PDB) ID 4QHL, downloaded from https://www.rcsb.org/structure/4QHL, last retrieved Nov. 4, 2020 (4 total pages).
Protein Data Bank Accession Code 5TPL, downloaded from https://www.rcsb.org/structure/5TPL, last retrieved Feb. 2, 2021 (4 total pages).
Protein Data Bank Accession Code 5TPP, downloaded from https://www.rcsb.org/structure/5TPP, last retrieved Feb. 2, 2021 (4 total pages).
Protein Data Bank Accession Code 5TQA, downloaded from https://www.rcsb.org/structure/5TQA, last retrieved Feb. 2, 2021 (4 total pages).
Protein Data Bank Accession Code 5TRP, downloaded from https://www.rcsb.org/structure/5TRP, last retrieved Feb. 2, 2021 (4 total pages).
Protein Data Bank Accession Code 5U0R, downloaded from https://www.rcsb.org/structure/5U0R, last retrieved Feb. 2, 2021 (4 total pages).
Protein Data Bank Accession Code 5U0U, downloaded from https://www.rcsb.org/structure/5U0U, last retrieved Feb. 2, 2021 (4 total pages).
Protein Data Bank Accession Code 5U15, downloaded from https://www.rcsb.org/structure/5U15, last retrieved Feb. 2, 2021 (4 total pages).
Rerks-Ngam, S., et al., "Vaccination with ALVAC and AIDSVAX to prevent HIV-1 infection in Thailand," The New England Journal of Medicine, vol. 361, pp. 2209-2220, Dec. 3, 2009, last retrieved Oct. 6, 2020 from https://www.nejm.org/doi/10.1056/NEJMoa0908492?url_ver=Z39.88-2003&rfr_id=ori:rid:crossref.org&rfr_dat=cr_pub Owww.ncbi.nlm.nih.gov (22 total pages).
Ringe, R.P., et al., "Influences on the Design and Purification of Soluble, Recombinant Native-Like HIV-1 Envelope Glycoprotein Trimers," Journal of Virology, vol. 89, No. 23, pp. 12189-12210 (Dec. 2015).
Salazar-Gonzalez, J F., et al., "Genetic identity, biological phenotype, and evolutionary pathways of transmitted/founder viruses in acute and early HIV-1 infection," The Journal of Experimental Medicine, vol. 206, No. 6, pp. 1273-1289 (Jun. 8, 2009).
Sanders, R.W., et al., "A Next-Generation Cleaved, Soluble HIV-1 Env Trimer, BG505 SOSIP.664 gp140, Expresses Multiple Epitopes for Broadly Neutralizing but Not Non-Neutralizing Antibodies," PLOS—Pathogens, vol. 9, Issue 9, e1003618, pp. 1-20 (published Sep. 19, 2013).
Santra, S., et al., "Mosaic Vaccines Elicit CD8+ T lymphocyte Responses in Monkeys that Confer Enhanced Immune Coverage of Diverse HIV Strains," Nat. Med., vol. 16, No. 3, pp. 324-328, Mar. 2010 (Author Manuscript—13 total pages—available in PMC Sep. 1, 2010).
Sarzotti-Kelsoe, M., et al., "Optimization and validation of the TZM-bl assay for standardized assessments of neutralizing antibodies against HIV-1," J Immunol Methods, pp. 131-146, doi:10.1016/j.jim.2013.11.022 (Jul. 2014), Author Manuscript—37 total pages (available in PMC Jul. 1, 2015).
Saunders, K.O., "Vaccine Elicitation of High Mannose-Dependent Neutralizing Antibodies against the V3-Glycan Broadly Neutralizing Epitope in Nonhuman Primates," Cell Rep. vol. 18, No. 9, pp. 2175-2188 (Feb. 28, 2017), Author Manuscript—25 total pages (available in PMC Apr. 28, 2017).
Scheid, J.F., et al., "Sequence and structural convergence of broad and potent HIV antibodies that mimic CD4 binding," Science, vol. 333, No. 6049, pp. 1633-1637 (Sep. 16, 2011)—Author Manuscript available in PMC May 15, 2012 (11 total pages).
Schmohl, L., and Schwarzer, D., "Sortase-mediated ligations for the site-specific modification of proteins," Current Opinion in Chemical Biology, vol. 22, pp. 122-128 (available online Oct. 6, 2014).
Seaman, M. S., et al., "Tiered Categorization of a Diverse Panel of HIV-1 Env Pseudoviruses for Assessment of Neutralizing Antibodies," Journal of Virology, vol. 84, No. 3, pp. 1439-1452 (Feb. 2010).
Sharma, S., et al., "Cleavage-Independent HIV-1 Env Trimers Engineered as Soluble Native Spike Mimetics for Vaccine Design," Cell Reports, vol. 11, pp. 539-550 with cover pages—13 total pages, (Apr. 28, 2015).
Shaw, G.M. and Hunter, Eric, "HIV transmission," Cold Spring Harbor Perspectives in Medicine, vol. 2, a006965, pp. 1-23 (2012).
Sheng, Z., et al., "Gene-Specific Substitution Profiles Describe the Types and Frequencies of Amino Acid Changes during Antibody Somatic Hypermutation," Front. Immunol., vol. 8, No. 537, published online May 10, 2017, last downloaded Oct. 7, 2020 from <https://www.ncbi.nim.nih.gov/pmc/articles/PMC5424261/>—27 total pages.
Simonich, C.A., et al., "HIV-1 Neutralizing Antibodies with Limited Hypermutation from an Infant," Cell, vol. 166, No. 1, pp. 77-87 (Jun. 30, 2016), Author Manuscript—16 total pages (available in PMC Jun. 30, 2017).
Sliepen, K., et al., "Presenting native-like HIV-1 envelope trimers on ferritin nanoparticles improves their immunogenicity," Retrovirology, vol. 12, No. 82, 5 total pages (2015).
Sok, D., "Promiscuous glycan site recognition by antibodies to the high-mannose patch of gp120 broadens neutralization of HIV," Science Translational Medicine, vol. 6, No. 236, 236ra63, May 14, 2014 (Author Manuscript—26 total pages—available in PMC Nov. 14, 2014).
Sok, D., "The effects of somatic hypermutation on neutralization and binding in the PGT121 family of broadly neutralizing HIV antibodies," PLoS—Pathogens, vol. 9, No. 11, e1003754, pp. 1-20 (published Nov. 21, 2013).
Steichen, J.M, et al., "HIV Vaccine Design to Target Germline Precursors of Glycan-Dependent Broadly Neutralizing Antibodies," Immunity, vol. 45, pp. 483-496 with cover page—15 total pages (Sep. 20, 2016).
Stewart-Jones, G.B., "Trimeric HIV-1-Env Structures Define Glycan Shields from Clades A, B, and G," Cell, vol. 165, pp. 813-826 (May 5, 2016) with cover page, pp. S1-S10, and Supplemental Information (cover page with pp. 1-23)—49 total pages.
Tabata, A., et al., "Development of a Sortase A-mediated Peptide-labeled Liposome Applicable to Drug-delivery Systems," Anticancer Research, vol. 35, pp. 4411-4417 (accepted May 12, 2015).
Teng, G., et al., "Immunoglobulin somatic hypermutation," Annu Rev Genet, vol. 41, pp. 107-120 (Jun. 4, 2007).
Tomaras, G.D., et al., "Initial B-Cell Responses to Transmitted Human Immunodeficiency Virus Type 1: Virion-Binding Immunoglobulin M (IgM) and IgG Antibodies Followed by Plasma Anti-gp41 Antibodies with Ineffective Control of Initial Viremia," Journal of Virology, vol. 82, No. 24, pp. 12449-12463 (Dec. 2008).
Tsukiji, S., et al., "Sortase-Mediated Ligation: A Gift from Gram-Positive Bacteria to Protein Engineering," ChemBioChem, vol. 10, pp. 787-798 (published online Feb. 6, 2009).
Wagh, K., et al., "Optimal Combinations of Broadly Neutralizing Antibodies for Prevention and Treatment of HIV-1 Clade C Infection," Public Library of Science Pathogens, vol. 12, No. 3: e1005520, pp. 1-27 (Mar. 30, 2016).
Walker, L.M., et al., "Broad and potent neutralizing antibodies from an African donor reveal a new HIV-1 vaccine target," Science, vol. 326, pp. 285-289 (Oct. 9, 2009) with correction dated Feb. 19, 2010.
Walker, L.M., et al., "Broad neutralization coverage of HIV by multiple highly potent antibodies," Nature, vol. 477, No. 7365, pp. 466-470, Sep. 22, 2011 (Author Manuscript—14 total pages—available in PMC Jul. 10, 2012).

(56) References Cited

OTHER PUBLICATIONS

West, Jr., A.P., et al., "Structural basis for germ-line gene usage of a potent class of antibodies targeting the CD4-binding site of HIV-1 gp120", Proceedings of the National Academy of Sciences, vol. 109, No. 30, pp. E2083-E2090 (published online Jun. 27, 2012).
Williams, W. B., et al., "Diversion of HIV-1 vaccine-induced immunity by gp41-microbiota cross-reactive antibodies," Science, vol. 349, No. 6249, aab1253, Aug. 14, 2015 (Author Manuscript—23 total pages—available in PMC Aug. 14, 2016).
Wu, X., et al., "Maturation and Diversity of the VRC01-Antibody Lineage over 15 Years of Chronic HIV-1 Infection," Cell, vol. 161, No. 3, pp. 470-485 (Apr. 23, 2015)—Author Manuscript available in PMC Apr. 23, 2016 (31 total pages).
Yaari, G. et al., "Models of Somatic Hypermutation Targeting and Substitution Based on Synonymous Mutations from High-Throughput Immunoglobulin Sequencing Data," Frontiers in Immunology, vol. 4, No. 358, pp. 1-19 (published online Nov. 15, 2013).
Yang. X., et al., "Antibody binding is a dominant determinant of the efficiency of human immunodeficiency virus type 1 neutralization," Journal of Virology, vol. 80, No. 22, pp. 11404-11408 (Nov. 2006).
Yeap, L.-S., et al., "Sequence-intrinsic mechanisms that target AID mutational outcomes on antibody genes," Cell, vol. 163, No. 5, pp. 1124-1137, Nov. 12, 2015 (Author Manuscript—26 total pages—available in PMC Nov. 19, 2016).
Yoon, H., et al., "CATNAP: a tool to compile, analyze and tally neutralizing antibody panels," Nucleic Acids Res., vol. 43 (Web Server issue), pp. W213-W219—10 total pages (Jun./Jul. 2015).
Yu, J.-S., et al., "Generation of Mucosal Anti-Human Immunodeficiency Virus Type 1 T-Cell Responses by Recombinant *Mycobacterium smegmatis*," Clinical and Vaccine Immunology, vol. 13, No. 11, pp. 1204-1211 (Nov. 2006).
Yu, J.-S., et al., "Recombinant *Mycobacterium bovis* Bacillus Calmette-Guerin Elicits Human Immunodeficiency Virus Type 1 Envelope-Specific T Lymphocytes at Mucosal Sites," Clinical and Vaccine Immunology, vol. 14, No. 7, pp. 886-893 (Jul. 2007).
Yu, L., et al., "Immunologic Basis for Long HCDR3s in Broadly Neutralizing Antibodies Against HIV-1," Front Immunol., vol. 5, No. 250, pp. 1-15 (published online Jun. 2, 2014).
Zhou, T, et al., "Multi-donor analysis reveals structural elements, genetic determinants, and maturation pathway for HIV-1 neutralization by VRCO1-class antibodies," Immunity, vol. 39, No. 2, pp. 245-258, published online Aug. 1, 2013 (Author Manuscript—17 total pages—available in PMC Apr. 14, 2014).
Zhou, T., et al., "Structural basis for broad and potent neutralization of HIV-1 by antibody VRC01," Science, vol. 329, No. 5993, pp. 811-817 (Aug. 13, 2010)—Author Manuscript available in PMC Aug. 13, 2011 (19 total pages).
Sanders, R.W., et al., "HIV-1 neutralizing antibodies induced by native-like envelope trimers," Science, vol. 349, Issue 6244, p. 154 with aac4223-1-aac4223-10 and cover pages—13 total pages (Jul. 10, 2015).
Afonine, P.V., et al., "Real-space refinement in PHENIX for cryo-EM and crystallography," Acta Crystallographica Section D, Structural Biology, vol. 74, pp. 531-544 (accepted Apr. 27, 2018).
Altschul, Stephen F., et al., "Basic Local Alignment Search Tool," J. Mol. Biol., vol. 215, pp. 403-410 (1990).
Altschul, Stephen F., et al., "Issues in searching molecular sequence databases", Nature Genetics, vol. 6, pp. 119-129 (Feb. 1994).
Barad, B.A., et al., "EMRinger: side chain-directed model and map validation for 3D Electron Cryomicroscopy," Nature Methods, vol. 12, No. 10. pp. 943-946 (Oct. 12, 2015)—Author Manuscript available in PMC Apr. 1, 2016 (13 total pages).
Barnes, C.O., et al., "Structural characterization of a highly-potent V3-glycan broadly neutralizing antibody bound to natively-glycosylated HIV-1 envelope," Nature Communications, vol. 9, No. 1251, pp. 1-12 (2018).
Bartesaghi, A., et al., "Atomic Resolution Cryo-EM Structure of β-Galactosidase," Structure, vol. 26, pp. 848-856 with pp. e1-e3 (Jun. 5, 2018).
Cao, J., et al., "Effects of amino acid changes in the extracellular domain of the human immunodeficiency virus type 1 gp41 envelope glycoprotein," Journal of virology, vol. 67, No. 5, 2747-2755 (May 1993).
Cao, L., et al., "Differential processing of HIV envelope glycans on the virus and soluble recombinant trimer," Nature Communications, vol. 9, No. 3693, pp. 1-14 (2018).
Chan, D.C., et al., "HIV Entry and Its Inhibition," Cell, vol. 93, pp. 681-684 (May 29, 1998).
Chen, V.B., et al., "MolProbity: all-atom structure validation for macromolecular crystallography," Acta Crystallographica Section D, Biological Crystallography, vol. 66, pp. 12-21 (2010).
Chuang, G.-Y., et al., "Structure-Based Design of a Soluble Prefusion-Closed HIV-1 Env Trimer with Reduced CD4 Affinity and Improved Immunogenicity," Journal of Virology, vol. 91, No. 10, e02268-16, pp. 1-18 (May 2017).
Corpet, Florence, "Multiple sequence alignment with hierarchical clustering," Nucleic Acids Research, vol. 16, No. 22, pp. 10881-10890 (1988).
Cowell, L.G., et al., "The Nucleotide-Replacement Spectrum Under Somatic Hypermutation Exhibits Microsequence Dependence That Is Strand-Symmetric and Distinct from That Under Germline Mutation," Journal of Immunology, vol. 164, pp. 1971-1976 with cover page—7 total pages (2000).
Crooks, E.T., et al., "Vaccine-Elicited Tier 2 HIV-1 Neutralizing Antibodies Bind to Quaternary Epitopes Involving Glycan-Deficient Patches Proximal to the CD4 Binding Site," Public Library of Science Pathogens, vol. 11, No. 5, e1004932, pp. 1-34 (May 29, 2015).
De Taeye, SW et al., HIV-1 envelope trimer design and immunization strategies to induce broadly neutrailizing antibodies, Trends in Immunology, vol. 37, No. 3, pp. 221-232 (Mar. 2016)—Author Manuscript available in PMC Jun. 2, 2017 (19 total pages).
Ding, S., et al., "A Highly Conserved gp120 Inner Domain Residue Modulates Env Conformation and Trimer Stability," Journal of Virology, vol. 90, No. 19, pp. 8395-8409 (Oct. 2016).
Dingens, A.S., et al., "Complete functional mapping of infection- and vaccine-elicited antibodies against the fusion peptide of HIV," Public Library of Science Pathogens, vol. 14, No. 7, e1007159, pp. 1-16 (Jul. 5, 2018).
Doran, R.C., et al., "Characterization of a monoclonal antibody to a novel glycan-dependent epitope in the V1/V2 domain of the HIV-1 envelope protein, gp120," Molecular Immunology, vol. 62, pp. 219-226 (available online Jul. 11, 2014).
Doria-Rose, N.A., "A short segment of the HIV-1 gp120 V1/V2 region is a major determinant of resistance to V1/V2 neutralizing antibodies," Journal of Virology, vol. 86, No. 15, pp. 8319-8323 (Aug. 2012).
Emsley, P., et al., "Features and development of Coot," Acta Crystallographica Section D, Biological Crystallography, vol. D66, pp. 486-501 (accepted Feb. 26, 2010).
Finzi, A., et al., "Topological Layers in the HIV-1 gp120 Inner Domain Regulate gp41 Interaction and CD4-Triggered Conformational Transitions," Molecular Cell, vol. 37, pp. 656-667 (Mar. 12, 2010).
Gardner, M.R., et al., "AAV-expressed eCD4-Ig provides durable protection from multiple SHIV challenges," Nature, vol. 519, No. 7541, pp. 87-91 (Mar. 5, 2015)—Author Manuscript available in PMC Sep. 5, 2015 (30 total pages).
Grant, T., et al., "Measuring the optimal exposure for single particle cryo-EM using a 2.6 Å reconstruction of rotavirus VP6," eLife, vol. 4, No. e06980, pp. 1-19 (May 29, 2015).
Grant, T., et al., "cisTEM, user-friendly software for single-particle image processing," eLife, vol. 7, No. e35383, pp. 1-24 (Mar. 7, 2018).
Gristick, H.B., et al., "Natively glycosylated HIV-1 Env structure reveals new mode for antibody recognition of the CD4-binding site," Nature Structural & Molecular Biology, vol. 23, No. 10, pp. 906-915 (Oct. 2016)—Author Manuscript available in PMC Apr. 1, 2017 (24 total pages).
Grupping, K., et al., "MiniCD4 protein resistance mutations affect binding to the HIV-1 gp120 CD4 binding site and decrease entry efficiency," Retrovirology, vol. 9, No. 36, pp. 1-16 (2012).

(56) References Cited

OTHER PUBLICATIONS

Harrison, S.C., "Viral membrane fusion," Nature Structural & Molecular Biology, vol. 15, No. 7, pp. 690-698 (Jul. 2008).
He, L., et al., "HIV-1 vaccine design through minimizing envelope metastability," Science Advances, vol. 4, eaau6769, pp. 1-19 with cover page—20 total pages (Nov. 21, 2018).
Herschhorn, A., et al., "The β20-β21 of gp120 is a regulatory switch for HIV-1 Env conformational transitions," Nature Communications, vol. 8, No. 1049, pp. 1-12 (2017).
Higgins, D.G. and Sharp, P.M., "CLUSTAL: a package for performing multiple sequence alignment on a microcomputer," Gene, vol. 73, pp. 237-244 (1988).
Higgins, D.G., et al., "Fast and sensitive multiple sequence alignments on a microcomputer," CABIOS Communications, vol. 5, No. 2, pp. 151-153 (1989).
Huang, J., et al., "Identification of a CD4-Binding-Site Antibody to HIV that Evolved Near-Pan Neutralization Breadth," Immunity, vol. 45, pp. 1108-1121 with cover page—15 total pages (Nov. 15, 2016).
Humphrey, W., et al., "VMD: Visual molecular dynamics," Journal of Molecular Graphics, vol. 14, pp. 33-38 (Feb. 1996).
Ingale, J., et al., "High-Density Array of Well-Ordered HIV-1 Spikes on Synthetic Liposomal Nanoparticles Efficiently Activate B Cells," Cell Reports, vol. 15, pp. 1986-1999 with cover pages—15 total pages (May 31, 2016).
International Search Report and Written Opinion issued by U.S. Patent and Trademark Office as International Application No. PCT/US18/20788 dated Jul. 2, 2018 (14 total pages).
International Search Report and Written Opinion issued by U.S. Patent and Trademark Office as International Application No. PCT/US2019/049431 dated Feb. 4, 2020 (11 total pages).
International Search Report and Written Opinion issued by U.S. Patent and Trademark Office as International Application No. PCT/US2019/049662 dated Feb. 11, 2020 (17 total pages).
International Search Report and Written Opinion issued by U.S. Patent and Trademark Office as International Application No. PCT/US2019/020436 dated Jul. 22, 2019 (12 total pages).
Juette, M.F., et al., "Single-molecule imaging of non-equilibrium molecular ensembles on the millisecond timescale," Nature Methods, vol. 13, No. 4, pp. 341-344 (Apr. 2016)—Author Manuscript available in PMC Aug. 15, 2016 (14 total pages).
Kong, L., et al., "Uncleaved prefusion-optimized gp140 trimers derived from analysis of HIV-1 envelope metastability," Nature Communications, vol. 7, No. 12040, pp. 1-15 (Jun. 28, 2016).
Korber, B., et al., "Polyvalent vaccine approaches to combat HIV-1 diversity," Immunological Reviews, vol. 275, pp. 230-244 (2017).
Kulp, D.W., et al., "Structure-based design of native-like HIV-1 envelope trimers to silence non-neutralizing epitopes and eliminate CD4 binding," Nature Communications, vol. 8, No. 1655, pp. 1-14 (2017).
Kwong, P.D., et al., "Structure of an HIV gp120 envelope glycoprotein in complex with the CD4 receptor and a neutralizing human antibody," Nature, vol. 393, No. 6686, pp. 648-659 (Jun. 18, 1998)—Author Manuscript available in PMC Oct. 6, 2017 (29 total pages).
Langley, D.R., et al., "Homology Models of the HIV-1 Attachment Inhibitor BMS 626529 Bound to gp120 Suggest a Unique Mechanism of Action," Proteins, vol. 83, pp. 331-350 (2015).
Lee, J.H., et al., "A Broadly Neutralizing Antibody Targets the Dynamic HIV Envelope Trimer Apex via a Long, Rigidified, and Anionic β-Hairpin Structure," Immunity, vol. 46, pp. 690-702, with cover page—14 total pages (Apr. 18, 2017).
Lee, J.H., et al., "Cryo-EM structure of a native, fully glycosylated, cleaved HIV-1 envelope trimer," Science, vol. 351, No. 6277, pp. 1043-1048 with cover page—7 total pages (Mar. 4, 2016).
Lemmin, T., et al., "Microsecond Dynamics and Network Analysis of the HIV-1 SOSIP Env Trimer Reveal Collective Behavior and Conserved Microdomains of the Glycan Shield," Structure, vol. 25, pp. 1631-1639 with pp. e1-e2 and cover page—12 pages (Oct. 3, 2017).
Liu, J., et al., "Molecular architecture of native HIV-1 gp120 trimers," Nature, vol. 455, pp. 109-113 with "Methods" (6 total pages) Sep. 4, 2008.
Liu, Q., et al., "Quaternary contact in the initial interaction of CD4 with the HIV-1 envelope trimer," Nature Structural & Molecular Biology, vol. 24, No. 4, Apr. 2017, pp. 370-378 with "Online Methods" and "Corrigendum: Quaternary contact in the initial interaction of CD4 with the HIV-1 envelope trimer," published online Feb. 20, 2017; corrected after print Apr. 27, 2017 (13 total pages).
Lu, M., et al., "Associating HIV-1 envelope glycoprotein structures with states on the virus observed by smFRET," Nature, vol. 568, No. 7752, pp. 415-419 (Apr. 2019) available in PMC Oct. 10, 2019 (36 total pages).
Ma, B.J., et al., "Envelope Deglycosylation Enhances Antigenicity of HIV1 gp41 Epitopes for Both Broad Neutralizing Antibodies and Their Unmutated Ancestor Antibodies," Public Library of Science Pathogens, vol. 7, No. 9, e1002200, pp. 1-16 (Sep. 1, 2011).
Ma, X., et al., "HIV-1 Envtrimer opens through an asymmetric intermediate in which individual protomers adopt distinct conformations," eLife, vol. 7, No. e34271, pp. 1-18 (Mar. 21, 2018).
Martinez-Murillo, P., et al., "Particulate Array of Well-Ordered HIV Clade C Env Trimers Elicits Neutralizing Antibodies that Display a Unique V2 Cap Approach," Immunity, vol. 46, pp. 804-817 with pp. e1-e7 (May 16, 2017).
McLellan, J.S., et al., "Structure of HIV-1 gp120 V1/V2 domain with broadly neutralizing antibody PG9," Nature, vol. 480, pp. 336-343 with "Methods" (10 total pages) Dec. 15, 2011.
Meanwell, N.A., et al., "Inhibitors of HIV-1 Attachment: The Discovery and Development of Temsavir and its Prodrug Fostemsavir," Journal of Medicinal Chemistry, vol. 61, pp. 62-80 (Dec. 22, 2017).
Mo, H., et al., "Conserved residues in the coiled-coil pocket of human immunodeficiency virus type 1 gp41 are essential for viral replication and interhelical interaction," Virology, vol. 329, pp. 319-327 (available online Sep. 25, 2004).
Munro, J.B., et al., "Structure and Dynamics of the Native HIV-1 Env Trimer," Journal of Virology, vol. 89, No. 11, pp. 5752-5755 (Jun. 2015).
Munro, S. et al. "Use of peptide tagging to detect proteins expressed from cloned genes: deletion mapping functional domains of *Drosophila* hsp70", The EMBO Journal, vol. 3, No. 13, pp. 3087-3093 (1984).
Needleman, S.B., et al. "A General Method Applicable to the Search for Similarities in the Amino Acid Sequence of Two Proteins" J. Mol. Biol., vol. 48, pp. 443-453 (1970).
Ozorowski, G., et al., "Open and closed structures reveal allostery and pliability in the HIV-1 envelope spike," Nature, vol. 547, pp. 360-363 with "Methods" (16 total pages), Jul. 20, 2017.
Pancera, M., et al., "Crystal structures of trimeric HIV envelope with entry inhibitors BMS-378806 and BMS-626529," Nature Chemical Biology, vol. 13, No. 10, pp. 1115-1122 (Oct. 2017)—Author Manuscript available in PMC Feb. 21, 2018 (24 total pages).
Pancera, M., et al., "Structure of HIV-1 gp 120 with gp41-interactive region reveals layered envelope architecture and basis of conformational mobility," Proceedings of the National Academy of Sciences of the United States of America, vol. 107, No. 3, pp. 1166-1171 (Jan. 19, 2010).
Pancera, M., et.al., "Structure and immune recognition of trimeric pre-fusion HIV-1 Env," Nature, vol. 514, No. 7523, pp. 455-461 (Oct. 23, 2014)—Author Manuscript available in PMC Apr. 23, 2015 pp. 1-42 with cover page 43 total pages.
Pearson, W. R., et al., "Improved tools for biological sequence comparison," Proc. Natl. Acad. Sci. U.S.A., vol. 85, pp. 2444-2448 (Apr. 1988).
Pettersen, E.F., et al., "UCSF Chimera—A Visualization System for Exploratory Research and Analysis," Journal of Computational Chemistry, vol. 25, No. 13, pp. 1605-1612 (2004).
Powell, R.L.R., et al., "Plasticity and Epitope Exposure of the HIV-1 Envelope Trimer," Journal of Virology, vol. 91, No. 17, e00410-00417, pp. 1-17 (Sep. 2017).
Pritz, S., et al., "Synthesis of Biologically Active Peptide Nucleic Acid-Peptide Conjugates by Sortase-Mediated Ligation," Journal of Organic Chemistry, vol. 72, pp. 3909-3912 (Published on Web Apr. 14, 2007).

(56) References Cited

OTHER PUBLICATIONS

Pugach, P., et al., "A Native-Like SOSIP.664 Trimer Based on an HIV-1 Subtype B env Gene," Journal of Virology, vol. 89, No. 6, pp. 3380-3395 (Mar. 2015).
Punjani, A., et al., "cryoSPARC: algorithms for rapid unsupervised cryo-EM structure determination," Nature Methods, vol. 14, No. 3, pp. 290-296 with "Online Methods" (8 total pages), Mar. 2017.
Rantalainen, K., et al., "Co-evolution of HIV Envelope and Apex-Targeting Neutralizing Antibody Lineage Provides Benchmarks for Vaccine Design," Cell Reports, vol. 23, pp. 3249-3261 with cover page—14 total pages (Jun. 12, 2018).
Rohou, A., et al., "CTFFIND4: Fast and accurate defocus estimation from electron micrographs," Journal of Structural Biology, vol. 192, No. 2, pp. 216-221, (Nov. 2015)—Author Manuscript available in PMC Sep. 25, 2019 (18 total pages).
Saunders, K.O., et al., "Vaccine Induction of Heterologous Tier 2 HIV-1 Neutralizing Antibodies in Animal Models," Cell Reports, vol. 21, pp. 3681-3690 (Dec. 26, 2017).
Scharf, L., et al., "Broadly Neutralizing Antibody 8ANC195 Recognizes Closed and Open States of HIV-1 Env," Cell, vol. 162, pp. 1379-1390 with cover page—13 total pages (Sep. 10, 2015).
Shaik, M.M., et al., "Structural basis of coreceptor recognition by HIV-1 envelope spike," Nature, vol. 565, No. 7739, pp. 318-323 (Jan. 2019)—Author Manuscript available in PMC Jun. 12, 2019 (34 total pages).
Smith, T. F., et al., "Comparison of Biosequences," Adv. Appl. Math., vol. 2, pp. 482-489 (1981).
Stamatatos, L., et al., "An Envelope Modification That Renders a Primary, Neutralization-Resistant Clade B Human Immunodeficiency Virus Type 1 Isolate Highly Susceptible to Neutralization by Sera from Other Clades," Journal of Virology, vol. 72, No. 10, pp. 7840-7845 (Oct. 1998).
Tang, G., et al., "EMAN2: An Extensible Image Processing Suite for Electron Microscopy," Journal of Structural Biology, Article in Press: 2006 (accepted May 31, 2006), doi:10.1016/j.jsb.2006.05.009, pp. 1-9.
Torrents de la Peña, A., et al., "Improving the Immunogenicity of Native-like HIV-1 Envelope Trimers by Hyperstabilization," Cell Reports, vol. 20, pp. 1805-1817 with cover page—14 total pages (Aug. 22, 2017).
Tran, E.E.H., et al., "Structural Mechanism of Trimeric HIV-1 Envelope Glycoprotein Activation," Public Library of Science Pathogens, vol. 8, Issue 7, e1002797, pp. 1-18 (Jul. 12, 2012).
Tria, G., et al., "Advanced ensemble modelling of flexible macromolecules using X-ray solution scattering," International Union of Crystallography Journal, vol. 2, pp. 207-217 (accepted Jan. 30, 2015).
Voss, J.E., et al., "Elicitation of Neutralizing Antibodies Targeting the V2 Apex of the HIV Envelope Trimer in a Wild-Type Animal Model," Cell Reports, vol. 21, pp. 222-235 with cover page—15 total pages (Oct. 3, 2017).
Wagh, K., et al., "Completeness of HIV-1 Envelope Glycan Shield at Transmission Determines Neutralization Breadth," Cell Reports, vol. 25, pp. 893-908 with pp. e1-e7 and cover page—24 total pages (Oct. 23, 2018).
Wang, H., et al., "Cryo-EM structure of a CD4-bound open HIV-1 envelope trimer reveals structural rearrangements of the gp120 V1V2 loop," Proceedings of the National Academy of Sciences of the United States of America, pp. E7151-E7158 https://doi.org/10.1073/pnas.1615939113 (published online Oct. 31, 2016).
Wang, H., et al., "Partially Open HIV-1 Envelope Structures Exhibit Conformational Changes Relevant for Coreceptor Binding and Fusion," Cell Host & Microbe, vol. 24, pp. 579-592 with pp. e1-e4 and cover page—19 total pages (Oct. 10, 2018).
Wang, R.Y.-R., et al., "Automated structure refinement of macromolecular assemblies from cryo-EM maps using Rosetta," eLife, vol. 5, No. e17219, pp. 1-22 (Sep. 26, 2016).
Wang, W., et al., "A systematic study of the N-glycosylation sites of HIV-1 envelope protein on infectivity and antibody-mediated neutralization," Retrovirology, vol. 10, No. 14, pp. 1-14 (2013).
Ward, A.B., et al., "Insights Into the Trimeric HIV-1 Envelope Glycoprotein Structure," Trends in Biochemical Sciences, vol. 40, No. 2, pp. 101-107 (Feb. 2015)—Author Manuscript available in PMC Feb. 1, 2016 (16 total pages).
Ward, A.B., et al., "The HIV-1 envelope glycoprotein structure: nailing down a moving target," Immunological Reviews, vol. 275, pp. 21-32 (2017).
Weissenhorn, W., et al., "Atomic structure of the ectodomain from HIV-1 gp41," Nature, 387, pp. 426-430 (May 22, 1997).
Xu, K., et al., "Epitope-based vaccine design yields fusion peptide-directed antibodies that neutralize diverse strains of HIV-1," Nature Medicine, vol. 24, Jun. 2018, pp. 857-867 with "Methods" and "Nature Research: Life Sciences Reporting Summary—Jun. 2017" (19 total pages).
Zhang, P., et al., "Interdomain Stabilization Impairs CD4 Binding and Improves Immunogenicity of the HIV-1 Envelope Trimer," Cell Host & Microbe, vol. 23, No. pp. 832-844 with cover page and pp. e1-e6—20 total pages (Jun. 13, 2018).
Zhou, T., et al., "Quantification of the Impact of the HIV-1-Glycan Shield on Antibody Elicitation," Cell Reports, vol. 19, pp. 719-732 with cover page—15 total pages (Apr. 25, 2017).
Zolla-Pazner, S., et al., "Structure/Function Studies Involving the V3 Region of the HIV-1 Envelope Delineate Multiple Factors That Affect Neutralization Sensitivity," Journal of Virology, vol. 90, No. 2, pp. 636-649 (Jan. 2016).

A

Figure 2D
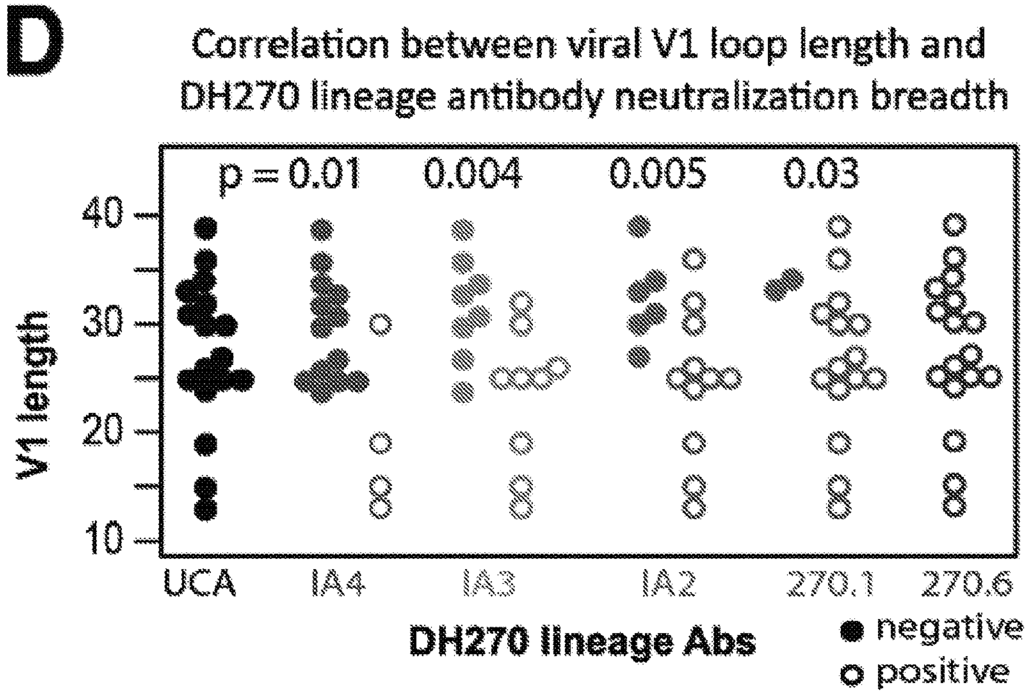
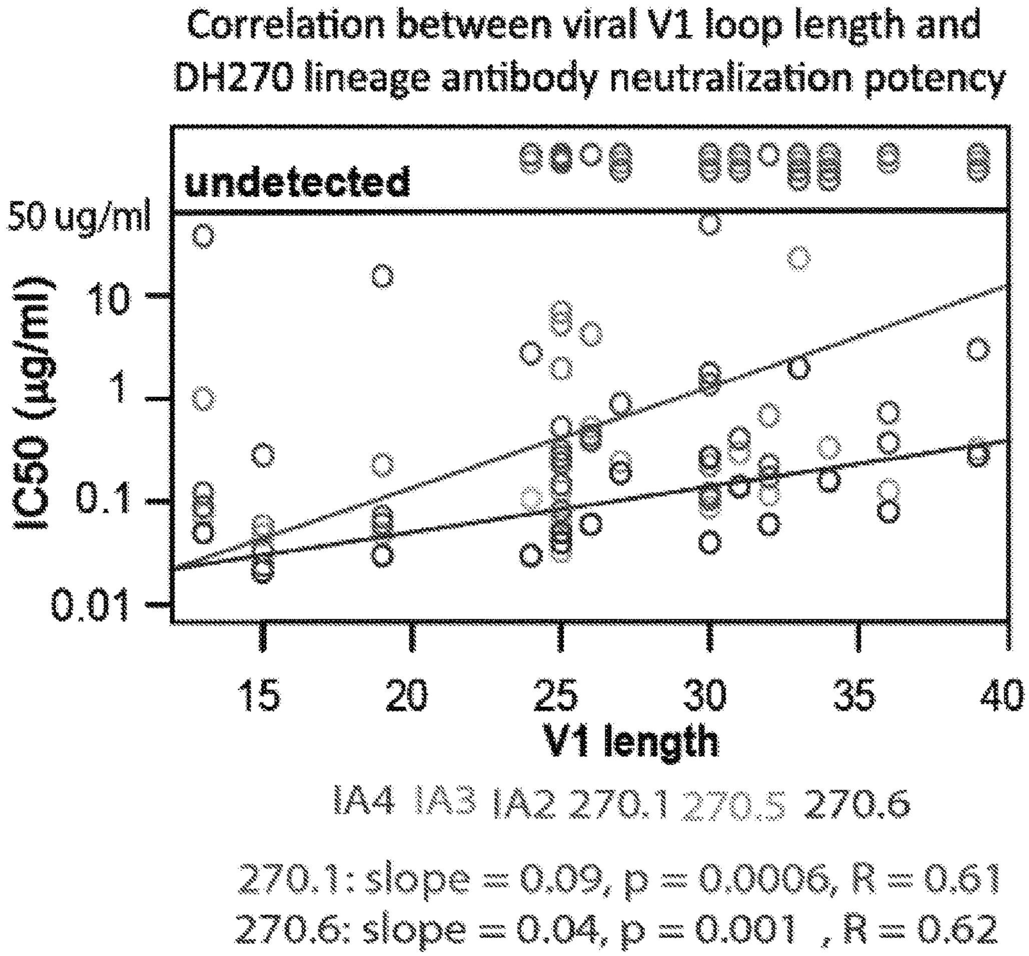

Figure 7A

| Antibody ID | $V_H$ | D | $J_H$ | Mutation frequency $V_H$ | Mutation frequency $V_HDJ_H$ nt | Mutation frequency $V_HDJ_H$ aa | CDRH3 length | VL | JL | Mutation frequency $V_L$ | Mutation frequency $V_LJ_L$ nt | Mutation frequency $V_LJ_L$ aa | CDRL3 length | Week of isolation | Inser dele |
|---|---|---|---|---|---|---|---|---|---|---|---|---|---|---|---|
| DH270.UCA | 1-2*02 | 3-22*01 | 4*02 | 0.0% | 0 (0%) | 0 (0%) | 20 | 2-23*02 | 2*01 | 0.0% | 0 (0%) | 0 (0%) | 10 | - | no |
| DH270.IA4 | 1-2*02 | 3-22*01 | 4*02 | 1.4% | 4/381 (1.0%) | 4/127 (3.1%) | 20 | 2-23*02 | 2*01 | 0.7% | 2/330 (0.6%) | 1/110 (0.9%) | 10 | - | no |
| DH270.IA2 | 1-2*02 | 3-22*01 | 4*02 | 2.1% | 7/381 (1.8%) | 7/127 (5.5%) | 20 | 2-23*02 | 2*01 | 2.1% | 6/330 (1.8%) | 3/110 (2.7%) | 10 | - | no |
| DH270.IA3 | 1-2*02 | 3-22*01 | 4*02 | 3.5% | 16/381 (4.2%) | 11/127 (8.7%) | 20 | 2-23*02 | 2*01 | 1.4% | 4/330 (1.2%) | 2/110 (1.8%) | 10 | - | no |
| DH270.1 | 1-2*02 | 3-22*01 | 4*02 | 5.6% | 21/381 (5.5%) | 18/127 (14.2%) | 20 | 2-23*02 | 2*01 | 5.2% | 21/330 (6.3%) | 11/110 (10.0%) | 10 | 205 | no |
| DH270.IA1 | 1-2*02 | 3-22*01 | 4*02 | 8.3% | 33/381 (8.7%) | 22/127 (17.3%) | 20 | 2-23*02 | 2*01 | 6.9% | 26/330 (7.9%) | 14/110 (12.7%) | 10 | - | no |
| DH270.2 | 1-2*02 | 3-22*01 | 4*02 | 10.8% | 46/381 (12.1%) | 27/127 (21.3%) | 20 | 2-23*02 | 2*01 | 3.8% | 13/330 (3.9%) | 7/110 (6.4%) | 10 | 232 | no |
| DH270.3 | 1-2*02 | 3-22*01 | 4*02 | 11.8% | 48/381 (12.6%) | 27/127 (21.3%) | 20 | 2-23*02 | 2*01 | 8.3% | 27/330 (8.2%) | 16/110 (14.5%) | 10 | 205 | [illegible] |
| DH270.4 | 1-2*02 | 3-22*01 | 4*02 | 11.5% | 44/381 (11.6%) | 28/127 (22.0%) | 20 | 2-23*02 | 2*01 | 8.0% | 29/330 (8.8%) | 16/110 (14.5%) | 10 | 232 | no |
| DH270.5 | 1-2*02 | 3-22*01 | 4*02 | 11.1% | 45/381 (11.8%) | 26/127 (20.5%) | 20 | 2-23*02 | 2*01 | 11.5% | 41/330 (12.4%) | 22/110 (20.0%) | 10 | 232 | no |
| DH270.6 | 1-2*02 | 3-22*01 | 4*02 | 12.9% | 47/381 (12.3%) | 28/127 (22.0%) | 20 | 2-23*02 | 2*01 | 7.6% | 39/330 (11.8%) | 17/110 (15.5%) | 10 | 234 | no |

22/207

Amino Acid Sequence Alignment of DH270 Lineage Antibodies $V_HDJ_H$ rearrangements

Amino Acid Sequence Alignment of DH270 Lineage Antibodies $V_LJ_L$ rearrangements

Neutralization $IC_{50}$ μg/ml

| | AC13.8 | | PVO.4 | | TRO.11 | | AC10.029 | | RHPA.4259 | |
|---|---|---|---|---|---|---|---|---|---|---|
| | wt | N332A | wt | N332A | wt | N332A | wt | N332A | wt | N332A |
| DH270.UCA | >50 | >50 | >50 | >50 | >50 | >50 | >50 | >50 | >50 | >50 |
| DH270.IA4 | >50 | >50 | 42 | >50 | 43 | >50 | >50 | >50 | >50 | >50 |
| DH270.IA3 | >50 | >50 | >50 | >50 | 0.2 | >50 | >50 | >50 | 6.6 | >50 |
| DH270.IA2 | >50 | >50 | >50 | >50 | 0.1 | >50 | >50 | >50 | 6.4 | >50 |
| DH270.1 | >50 | >50 | 0.2 | >50 | 0.08 | >50 | 1.9 | >50 | 0.2 | >50 |
| DH270.IA1 | >50 | >50 | 0.07 | >50 | 0.05 | 32.4 | <0.02 | >50 | 0.04 | >50 |
| DH270.2 | 21 | >50 | 0.3 | >50 | 0.06 | >50 | 0.3 | >50 | 0.1 | >50 |
| DH270.3 | >50 | >50 | 23 | >50 | 0.3 | >50 | 43 | >50 | 42 | >50 |
| DH270.4 | 15 | >50 | 0.1 | >50 | 0.04 | 14 | <0.02 | >50 | 0.05 | >50 |
| DH270.5 | 41 | >50 | 0.1 | >50 | 0.07 | >50 | <0.02 | >50 | 0.04 | >50 |
| DH270.6 | 1.4 | >50 | 0.03 | >50 | 0.02 | >50 | <0.02 | >50 | <0.02 | >50 |

| Antibody ID | $V_H$ | D | $J_H$ | $V_H$ mutation frequency | CDRH3 length | $V_L$ | $J_L$ | κ/λ | $V_L$ mutation frequency | CDRL3 length | Week of isolation | Insertions/ deletions |
|---|---|---|---|---|---|---|---|---|---|---|---|---|
| DH475 | 3-23*01 | 2-8*02 | 3*01 | 10.1% | 19 | 4-69*02 | 1*01 | λ | 10.9% | 9 | 232 | none |
| DH272 | 1-2*02 | 3-3*01 | 4*02 | 14.9% | 17 | 2-30*02 | 2*02 | κ | 5.1% | 9 | 205 | -6 FRH3 |

A:Green, T:Red, G:Orange, C:Light blue, Gaps:Gray

```
                     10         20         30         40         50         60         70         80         90
             ....|....| ....|....| ....|....| ....|....| ....|....| ....|....| ....|....| ....|....| ....|....| ....|...
DH270.UCA    QVQLVQSGAE VKKPGASVKV SCKASGYTFT GYYMHWVRQA PGQGLEWMGW INPNSGGTNY AQKFQGRVTM TRDTSISTAY MELSRLRSDD TAVYYCAR
DH270.IA4    .......... .......... .......... D..I...... .......... ....T.R... .......... .......... .......... .......
DH270.IA2    .......... M......... .......... D..I...... .......... ....T.R... .......... .......... ......T... .......T
DH270.IA1    .......... M.N....... ..A....... DF.I....L. .......... M..KT.R..N ..N....... ......G... ...R..T... ......VT
DH270.IA3    .......... .......... .......... D..I...... ........A. ...TT.R... .R........ .......... ...R...... ........
DH270.1      .......... M.......R. .......... D..I...... ....P..... ...ST.R..S P......... .......... .D.N..T... ..M...TT
DH270.3      .......... L......... ........LS D..V..L... .......VA. ...T..R.IS PR........ .T...MNV.. ...RG..... ....F...
DH270.4      E......... M.N....... ..A...G... DF.I....L. ..H..Q.... M..KT.R..N ..D......L ......G... ...R..T... ......VT
DH270.5      .......... ..N....... ..AP...... DF.I....L. .......L.. M..KT.R..Q G.N....... ......G... ...RS.T... ......VT
DH270.2      E...E..P.. L.E....... .......... D..I...... ........A. ...TT.RSSF .RG....... ..E..V.... ...R...... .......K
DH270.6      .........Q M.N....... ..AP...... DF.I..L... .....Q.... M..QT.R..T .RN....... ......G... ...RS.TV.. ....F.TT

VH1-2*02     .......... .......... .......... .......... .......... .......... .......... .......... .......... ........
Genomic DNA  .......... .......... .......I.. D......... ...E.G...R .......... .......... .......... T..S...E.. ..T.....
```

```
UCA1_HC    QVQLVQSGAEVKKPGASVKVSCKASGYTFTGYYMHWVRQAPGQGLEWMGWINPNSGGTNY
UCA3_HC    QVQLVQSGAEVKKPGASVKVSCKASGYTFTGYYMHWVRQAPGQGLEWMGWINPNSGGTNY
UCA4_HC    QVQLVQSGAEVKKPGASVKVSCKASGYTFTGYYMHWVRQAPGQGLEWMGWINPNSGGTNY
           ************************************************************

UCA1_HC    AQKFQGRVTMTRDTSISTAYMELSRLRSDDTAVYYCATGGWIGLYYDSSGYPNFDYWGQG
UCA3_HC    AQKFQGRVTMTRDTSISTAYMELSRLRSDDTAVYYCARGGWISLYYDSSGYPNFDYWGQG
UCA4_HC    AQKFQGRVTMTRDTSISTAYMELSRLRSDDTAVYYCARGGWIGLYYDSSGYPNFDYWGQG
           ************************************* ****.*****************

UCA1_HC    TLVTVS
UCA3_HC    TLVTVS
UCA4_HC    TLVTVS
           ******
```

B

```
UCA3_LC    QSALTQPASVSGSPGQSITISCTGTSSDVGSYNLVSWYQQHPGKAPKLMIYEVSKRPSGV
UCA1_LC    QSALTQPASVSGSPGQSITISCTGTSSDVGSYNLVSWYQQHPGKAPKLMIYEVSKRPSGV
           ************************************************************

UCA3_LC    SNRFSGSKSGNTASLTISGLQAEDEADYYCCSYAGSSTVIFGGGTKLTVL
UCA1_LC    SNRFSGSKSGNTASLTISGLQAEDEADYYCCSYAGSSIILFGGGTKLTVL
           ************************************* ::**********
```

| | | gp120 Binding AUC | | | | | | | | | Neutralization IC50 | | | | | | | | |
|---|---|---|---|---|---|---|---|---|---|---|---|---|---|---|---|---|---|---|---|
| Boost | Subject.day.clone | UCA | IA4 | IA3 | IA2 | I | IA1 | 4 | 5 | 6 | UCA | IA4 | IA3 | IA2 | I | IA1 | 4 | 5 | V1 loop length |
| i. | CH848.0949.10.17 | 0 | 2.5 | 6.3 | 9.4 | 12.9 | 13.6 | 14.3 | 14.6 | 14.3 | >50 | 0.64 | 0.2 | 0.14 | 0.18 | <0.02 | 0.03 | 0.05 | 17 |
| ii. | CH848.0836.10.31 | 0 | 0.0 | 4.9 | 9.4 | 13.2 | 13.5 | 13.2 | 14.5 | 14.2 | >50 | 45.69 | 0.07 | <0.02 | <0.02 | <0.02 | <0.02 | <0.02 | 17 |
| iii. | CH848.0358.80.06 | 0 | 0.0 | 0.0 | 0.3 | 11.2 | 13.6 | 14.9 | 15.3 | 13.8 | >50 | >50 | >50 | >50 | 1.3 | 0.02 | <0.02 | <0.02 | 24 |
| iii. | CH848.1432.5.41 | 0 | 0.0 | 0.0 | 0.8 | 11.7 | 12.7 | 12.7 | 14.6 | 14.0 | >50 | >50 | >50 | >50 | 2.6 | 0.33 | 0.26 | 0.21 | 30 |
| iii. | CH848.0526.25.02 | 0 | 0.0 | 0.0 | 0.0 | 8.8 | 12.0 | 13.6 | 13.8 | 13.8 | >50 | >50 | >50 | >50 | 16.7 | 1.4 | 1.1 | 1.6 | 34 |

Figure 29

| HIV-1 strain | CH848 plasma neutralization, week 186 post-transmission ($EC_{50}$ titer) | | |
|---|---|---|---|
| | Wild-type A | N332A mutant | Fold-difference |
| **Q23.17** | 962 | 150 | 6 |
| **Du156** | 170 | <40 | 4 |
| **TRO.11** | 204 | <40 | 5 |
| **Consensus C** | 4,261 | 1,569 | 3 |

Figures 30A-30C

A. DH270 Lineage

| Week[a] | Sample A | Sample B | Overlap[d] | Total[e] |
|---|---|---|---|---|
| 11 | 0 | 0 | 0 | 32,732 |
| 19 | 0 | 0 | 0 | 31,179 |
| 64 | 1 | 0 | 0 | 19,383 |
| 111 | 0 | 0 | 0 | 87,224 |
| 160 | 0 | 0 | 0 | 114,729 |
| 186 | 9,365 | 14,268 | 776 | 161,104 |
| 240[c] | 3 | 251 | 1 | 171,012 |

B. DH272 Lineage

| Week[a] | Sample A | Sample B | Overlap | Total |
|---|---|---|---|---|
| 11 | 0 | 0 | 0 | 32,732 |
| 19 | 1,634 | 2,782 | 105 | 31,179 |
| 64 | 48 | 0 | 0 | 19,383 |
| 111 | 558 | 684 | 42 | 87,224 |
| 160 | 0 | 0 | 0 | 114,729 |
| 186 | 596 | 509 | 36 | 161,104 |
| 240[c] | 0 | 7 | 0 | 171,012 |

C. DH475 Lineage

| Week[b] | Sample A | Sample B | Overlap | Total |
|---|---|---|---|---|
| 11 | 0 | 0 | 0 | 30,764 |
| 19 | 0 | 0 | 0 | 39,784 |
| 64 | 378 | 276 | 3 | 21,353 |
| 111 | 0 | 0 | 0 | 30,925 |
| 160 | 0 | 0 | 0 | 96,301 |
| 186 | 788 | 1590 | 50 | 37,648 |
| 240[c] | 0 | 0 | 0 | 171,012 |

a Reads from $V_H1$ family-targeted Illumina
b Reads from $V_H3$ family-targeted Illumina
c Reads from $V_H1$ through $V_H6$ families-targeted Illumina
d Number of clonally-related $V_HDJ_H$ sequences that replicated across samples A and B
e Total number of replicated sequences at each timepoint

Figure 31

| HIV-1 strain | Week post-transmission, neutralization $IC_{50}$ μg/ml | | | | | | | |
|---|---|---|---|---|---|---|---|---|
| | 51 | 100 | 111 | 113 | 136 | 160 | 186 | 205 |
| Du172.17 | 31 | 81 | 117 | 95 | 61 | 101 | 83 | 415 |
| 6535.3 | <10 | <10 | <10 | 32 | <10 | 115 | 460 | 1,363 |
| Q23.17 | <10 | <10 | <10 | <10 | 64 | <10 | 37 | 1,483 |
| Du156.12 | <10 | <10 | <10 | <10 | <10 | 25 | 280 | 682 |
| SC422661.8 | <10 | <10 | <10 | <10 | <10 | 38 | 92 | 207 |
| Q842.d12 | <10 | <10 | <10 | <10 | <10 | 50 | 74 | 54 |
| QH0692.42 | <10 | <10 | <10 | <10 | <10 | <10 | 56 | 100 |
| PVO.4 | <10 | <10 | <10 | <10 | <10 | <10 | 32 | 251 |
| AC10.0.29 | <10 | <10 | <10 | <10 | <10 | <10 | 21 | 209 |
| RHPA4259.7 | <10 | <10 | <10 | <10 | <10 | <10 | 59 | 250 |
| Du422.1 | <10 | <10 | <10 | <10 | <10 | <10 | 152 | 341 |
| ZM197M.PB7 | <10 | <10 | <10 | <10 | <10 | <10 | 43 | 105 |
| Q259.d2.17 | <10 | <10 | <10 | <10 | <10 | <10 | <10 | 112 |
| ZM214M.PL15 | <10 | <10 | <10 | <10 | <10 | <10 | <10 | 37 |
| Q769.d22 | <10 | <10 | <10 | <10 | <10 | <10 | <10 | <10 |
| CAP45.2.00.G3 | <10 | <10 | <10 | <10 | <10 | <10 | <10 | <10 |
| SVA-MLV | <10 | <10 | <10 | <10 | <10 | <10 | <10 | <10 |

Figure 32

| **Data Collection** | | | | | | | |
|---|---|---|---|---|---|---|---|
| | **UCA1** | **UCA3** | **DH270.1** | **DH270.3** | **DH270.5** | **DH270.6** | **DH272** |
| Resolution (Å) | 50 - 3.31 (3.37 - 3.31) | 50 - 2.26 (2.30 - 2.26) | 50 - 3.47 (3.53 - 3.47) | 50 - 2.50 (2.54 - 2.50) | 50 - 1.85 (1.88 - 1.85) | 50 - 2.73 (2.78 - 2.73) | 50 - 2.68 (2.73 - 2.68) |
| Space group | R 3 2 | C 1 2 1 | C 1 2 1 | P 21 21 21 | C 1 2 1 | P 1 21 1 | I 2 2 2 |
| Unit cell a,b,c (Å) | 209.1, 209.1, 83.5 | 98.5, 76.9, 137.1 | 156.873 111.284 89.134 | 63.2, 69.3, 115.2 | 135.1, 68.8, 59.5 | 67.1, 73.7, 112.7 | 60.9, 124.5, 146.2 |
| Unit cell α, β, γ (°) | 90 90 120 | 90, 102, 90 | 90, 120.46, 90 | 90, 90, 90 | 90, 113, 90 | 90, 107, 90 | 90, 90, 90 |
| Total reflections | 65247 | 142800 | 32526 | 57856 | 126544 | 57894 | 47496 |
| Unique reflections | 10410 | 46692 | 14420 | 17599 | 42441 | 27592 | 15439 |
| Redundancy | 6.3 (5.0) | 3.1 (3.0) | 2.3 (2.2) | 3.3 (3.0) | 3.0 (2.1) | 2.1 (2.1) | 1.7 (1.6) |
| Completeness (%) | 97.6 (90.5) | 99.1 (98.9) | 80.9 (77.0) | 97.1 (98.4) | 96.2 (83.9) | 97.2 (92.8) | 97.5 (94.4) |
| $\langle I/\sigma_I \rangle$ | 7.0 (1.9) | 7.3 (1.5) | 4.6 (1.4) | 6.8 (1.9) | 5.6 (1.7) | 6.00 (1.4) | 9.3 (2.6) |
| $R_{merge}$ | 21.0 (88.3) | 9.6 (87.8) | 23.3 (50.3) | 12.9 (56.9) | 15.3 (54.6) | 11.2 (64.2) | 11.9 (63.8) |
| **Refinement** | | | | | | | |
| $R_{work}/R_{free}$ (%) | 24.5/27.3 (33.1/39.4) | 21.6/25.5 (33.0/35.2) | 25.4/28.2 (32.2/33.4) | 21.5/24.9 (33.0/43.3) | 17.9/21.2 (24.1/26.9) | 19.1/20.9 (31.7/32.4) | 21.1/25.6 (34.6/37.0) |
| No. atoms | | | | | | | |
| Protein | 3195 | 6290 | 7157 | 3250 | 3313 | 6582 | 3361 |
| Ligand | 10 | 0 | | | 16 | | 33 |
| Water | 3 | 274 | 0 | 114 | 415 | 107 | 75 |
| R.M.S. deviations | | | | | | | |
| Bond lengths (Å) | 0.006 | 0.005 | 0.005 | 0.010 | 0.007 | 0.004 | 0.003 |
| Bond angles (°) | 0.98 | 1.13 | 0.89 | 1.33 | 1.25 | 0.91 | 0.81 |
| B-factors ($Å^2$) | | | | | | | |
| Protein | 53.40 | 56.80 | 61.20 | 41.80 | 25.60 | 55.20 | 51.00 |
| Ligand | 98.00 | | | | 47.60 | | 61.50 |
| Solvent | 60.00 | 49.50 | 39.20 | 39.20 | 40.90 | 42.00 | 40.10 |

Statistics for the highest-resolution shell are shown in parentheses.

Figure 33

| Virus ID | Clade or CRF | Clade | 331-336 | N332 glycan | LengthV1 | DH270.1 | DH270.5 | DH270.6 | | 10-1074 | PGT128 | PGT121 |
|---|---|---|---|---|---|---|---|---|---|---|---|---|
| 398-F1_F6_20 | A | A | CNVSKA | 332 | 21 | 0.038 | 0.036 | 0.021 | | 0.0003 | 0.005 | 0.0027 |
| RW020.2 | A | A | CNVSRA | 332 | 15 | 0.051 | 0.052 | 0.012 | | 0.0003 | 0.004 | 0.0037 |
| Q23.17 | A | A | CNVTRS | 332 | 19 | 0.058 | 0.049 | 0.019 | | 0.0003 | 0.010 | 0.0005 |
| KNH1209.18 | A | A | CNVSRS | 332 | 24 | 0.325 | 0.044 | 0.028 | | 0.0008 | 0.009 | 0.0007 |
| BI369.9A | A | A | CNVSRS | 332 | 36 | 0.407 | 0.301 | 0.112 | | 0.002 | 0.030 | 0.008 |
| MI369.A5 | A | A | CNVSRS | 332 | 35 | 0.501 | 0.480 | 0.166 | | 0.002 | 0.022 | 0.009 |
| UG037.8 | A | A | CNVSGS | 332 | 27 | 1.53 | 0.290 | 0.058 | | 0.031 | 0.023 | 0.011 |
| 0260.v5.c36 | A | A | CNVSKA | 332 | 44 | 2.32 | 2.18 | 0.378 | | 0.130 | 0.037 | 0.056 |
| KER2008.12 | A | A | CNVSKS | 332 | 32 | 14.6 | 0.133 | 0.047 | | 0.123 | >50 | 2.10 |
| 0330.v4.c3 | A | A | CNVSGT | 332 | 15 | >50 | 14.6 | 1.83 | | 0.010 | 0.377 | 0.067 |
| 3365.v2.c20 | A | A | CNVSQT | 332 | 22 | >50 | >50 | 10.3 | | 0.003 | >50 | 0.133 |
| BS208.B1 | A | A | CNVSGS | 332 | 15 | >50 | >50 | 13.3 | | 15.1 | >50 | >25 |
| BB201.B42 | A | A | CNVSRS | 332 | 19 | >50 | >50 | >50 | | 0.0003 | 0.004 | 0.0008 |
| 3415.v1.c1 | A | A | CNVSRK | 332 | 24 | >50 | >50 | >50 | | >50 | 0.010 | >25 |
| 0439.v5.c1 | A | A | CNVSKT | 332 | 38 | >50 | >50 | >50 | | >50 | 1.38 | >25 |
| MS208.A1 | A | A | CNVSGS | 332 | 23 | >50 | >50 | >50 | | >50 | >50 | >25 |
| Q259.17 | A | A | CTVNRT | 334 | 18 | >50 | >50 | >50 | | 1.94 | >50 | >25 |
| MB201.A1 | A | A | CKVNRS | 334 | 19 | >50 | >50 | >50 | | >50 | 0.009 | 0.0006 |
| Q842.d12 | A | A | CNVNRT | 334 | 19 | >50 | >50 | >50 | | >50 | 0.042 | 0.007 |
| MB539.2B7 | A | A | CTVNRT | 334 | 23 | >50 | >50 | >50 | | >50 | 1.41 | >25 |
| 3718.v3.c11 | A | A | CHVNKT | 334 | 25 | >50 | >50 | >50 | | >50 | >50 | 1.12 |
| KER2018.11 | A | A | CVVNRT | 334 | 24 | >50 | >50 | >50 | | >50 | >50 | >25 |
| QH209.14M.A2 | A | A | CIVNKT | 334 | 28 | >50 | >50 | >50 | | >50 | >50 | >25 |
| BB539.2B13 | A | A | CTVNRT | 334 | 22 | >50 | >50 | >50 | | >50 | >50 | >25 |
| Q461.e2 | A | AD | CVVNRT | 334 | 27 | >50 | >50 | >50 | | >50 | >50 | >25 |
| BG505.W6M.C2 | A | A | CTVSKA | none | 19 | >50 | >50 | >50 | | >50 | 0.049 | 0.024 |
| Q769.d22 | A | A | CNVNRQ | none | 24 | >50 | >50 | >50 | | >50 | >50 | >25 |
| Q769.h5 | A | A | CNVNRQ | none | 26 | >50 | >50 | >50 | | >50 | >50 | >25 |
| BJOX028000.10.3 | CRF01-AE | AE | CNISRT | 332 | 31 | >50 | >50 | >50 | | >50 | 0.025 | >25 |
| C3347.c11 | CRF01-AE | AE | CEINGT | 334 | 32 | >50 | >50 | >50 | | >50 | 0.006 | >25 |
| BJOX009000.02.4 | CRF01-AE | AE | CEINGT | 334 | 27 | >50 | >50 | >50 | | >50 | 0.008 | 2.36 |
| TH966.8 | CRF01-AE | AE | CEINGT | 334 | 29 | >50 | >50 | >50 | | >50 | 0.009 | >25 |
| CM244.ec1 | CRF01-AE | AE | CEINGT | 334 | 34 | >50 | >50 | >50 | | >50 | 0.013 | >25 |
| C2101.c1 | CRF01-AE | AE | CEINET | 334 | 28 | >50 | >50 | >50 | | >50 | 0.014 | >25 |
| CNE8 | CRF01-AE | AE | CEINRT | 334 | 26 | >50 | >50 | >50 | | >50 | 0.014 | >25 |
| CNE5 | CRF01-AE | AE | CEINGT | 334 | 30 | >50 | >50 | >50 | | >50 | 0.062 | >25 |
| C1080.c3 | CRF01-AE | AE | CEINGT | 334 | 28 | >50 | >50 | >50 | | >50 | 0.100 | >25 |
| CNE56 | CRF01-AE | AE | CKINGT | 334 | 27 | >50 | >50 | >50 | | >50 | 1.18 | >25 |
| R2184.c4 | CRF01-AE | AE | CVINGT | 334 | 30 | >50 | >50 | >50 | | >50 | 1.36 | >25 |
| BJOX010000.06.2 | CRF01-AE | AE | CKINAT | 334 | 34 | >50 | >50 | >50 | | >50 | 1.97 | >25 |
| 620345.c1 | CRF01-AE | AE | CEINGT | 334 | 29 | >50 | >50 | >50 | | >50 | >50 | >25 |
| BJOX025000.01.1 | CRF01-AE | AE | CEINGT | 334 | 28 | >50 | >50 | >50 | | >50 | >50 | >25 |

Figure 33 continued

| Virus ID | Clade or CRF | Clade | 331-336 | N332 glycan | LengthV1 | DH270.1 | DH270.5 | DH270.6 | 10-1074 | PGT128 | PGT121 |
|---|---|---|---|---|---|---|---|---|---|---|---|
| CNE3 | CRF01-AE | AE | CEINRT | 334 | 37 | >50 | >50 | >50 | >50 | >50 | >25 |
| CNE59 | CRF01-AE | AE | CEINGT | 334 | 27 | >50 | >50 | >50 | >50 | >50 | >25 |
| R1166.c1 | CRF01-AE | AE | CEINRT | 334 | 41 | >50 | >50 | >50 | >50 | >50 | >25 |
| R3265.c6 | CRF01-AE | AE | CEINQT | 334 | 29 | >50 | >50 | >50 | >50 | >50 | >25 |
| TH976.17 | CRF01-AE | AE | CEINET | 334 | 34 | >50 | >50 | >50 | >50 | >50 | >25 |
| M02138 | CRF01-AE | AE | CKINGT | 334 | 27 | >50 | >50 | >50 | >50 | >50 | >25 |
| TH023.6 | CRF01-AE | AE | CEINGA | 334 | 29 | >50 | >50 | >50 | >50 | 0.176 | >25 |
| C4118.09 | CRF01-AE | AE | CEIDGT | none | 29 | >50 | >50 | >50 | >50 | >50 | >25 |
| CNE55 | CRF01-AE | AE | CEIDGT | none | 25 | >50 | >50 | >50 | >50 | >50 | >25 |
| DJ263.8 | CRF02-AG | AG | CNVSRS | 332 | 36 | 0.201 | 0.128 | 0.066 | 0.308 | >50 | 0.053 |
| 269-12 | CRF02-AG | AG | CNVSTT | 332 | 25 | 2.74 | 0.184 | 0.036 | 0.004 | 0.010 | 0.236 |
| 235-47 | CRF02-AG | AG | CNVSST | 332 | 22 | 3.11 | 0.557 | 0.301 | 0.004 | >50 | 0.289 |
| T266-60 | CRF02-AG | AG | CNVSGK | 332 | 40 | 6.21 | 5.04 | 0.462 | 0.082 | 0.016 | 0.118 |
| 263-8 | CRF02-AG | AG | CNVSKG | 332 | 29 | >50 | 2.56 | 0.191 | 0.092 | 0.211 | 0.872 |
| 928-28 | CRF02-AG | AG | CNVSKI | 332 | 25 | >50 | >50 | 2.12 | 0.530 | >50 | 14.3 |
| T251-18 | CRF02-AG | AG | CNVSRG | 332 | 24 | >50 | >50 | 10.5 | 0.169 | >50 | 6.17 |
| T278-50 | CRF02-AG | AG | CNVSGT | 332 | 26 | >50 | >50 | 11.6 | 0.247 | 0.036 | >25 |
| T250-4 | CRF02-AG | AG | CNVSKR | 332 | 22 | >50 | >50 | >50 | 0.0003 | 0.004 | 0.0024 |
| T255-34 | CRF02-AG | AG | CNVSK- | 332 | 28 | >50 | >50 | >50 | 0.330 | >50 | 12.5 |
| T253-11 | CRF02-AG | AG | CNVSKT | 332 | 25 | >50 | >50 | >50 | 2.70 | >50 | >25 |
| 271-11 | CRF02-AG | AG | CEVNRT | 334 | 30 | >50 | >50 | >50 | >50 | >50 | [illegible] |
| 242-14 | CRF02-AG | AG | CVVNKT | 334 | 24 | >50 | >50 | >50 | >50 | >50 | >25 |
| T257-31 | CRF02-AG | AG | CKVNKT | 334 | 33 | >50 | >50 | >50 | >50 | >50 | >25 |
| T33-7 | CRF02-AG | AG | CEVNRT | 334 | 30 | >50 | >50 | >50 | >50 | >50 | >25 |
| BJOX002000.03.2 | CRF07_BC | BC | CNISGK | 332 | 22 | 0.096 | 0.046 | 0.021 | 0.011 | 0.016 | 0.008 |
| CH119.10 | CRF07_BC | BC | CNIS-- | 332 | 21 | 0.235 | 0.077 | 0.049 | 0.020 | 0.020 | 0.017 |
| CNE21 | CRF07_BC | BC | CNISET | 332 | 26 | 0.535 | 0.129 | 0.060 | 0.014 | 0.012 | 0.002 |
| CH181.12 | CRF07_BC | BC | CNISRD | 332 | 30 | 0.773 | 0.320 | 0.102 | 0.011 | 0.022 | 0.012 |
| CNE19 | CRF07_BC | BC | CNISKD | 332 | 22 | >50 | 0.093 | 0.036 | 0.027 | >50 | 0.0008 |
| CNE20 | CRF07_BC | BC | CNISEN | 332 | 17 | >50 | >50 | 4.32 | 0.0003 | 0.002 | 0.0001 |
| CH117.4 | CRF07_BC | BC | CNINRT | 334 | 24 | >50 | >50 | >50 | >50 | >50 | >25 |
| SF162.LS | B | B | CNISGE | 332 | 26 | 0.036 | 0.022 | 0.009 | 0.0003 | 0.006 | 0.0007 |
| CNE14 | B | B | CNLSRT | 332 | 26 | 0.066 | 0.043 | 0.021 | 0.0003 | 0.013 | 0.0008 |
| BX08.16 | B | B | CNISRT | 332 | 20 | 0.074 | 0.078 | 0.026 | 0.0003 | 0.007 | 0.0008 |
| JRFL.JB | B | B | CNISRA | 332 | 25 | 0.075 | 0.033 | 0.019 | 0.0010 | 0.010 | 0.008 |
| SS1196.01 | B | B | CNISRK | 332 | 21 | 0.060 | 0.067 | 0.021 | 0.0003 | 0.011 | 0.0008 |
| CAAN.A2 | B | B | CNISGE | 332 | 24 | 0.066 | 0.106 | 0.027 | 0.0006 | 0.124 | 0.003 |
| 3988.25 | B | B | CNISRT | 332 | 23 | 0.090 | 0.034 | 0.018 | 0.0007 | 0.004 | 0.0008 |
| 45_01dG5 | B | B | CNISKA | 332 | 27 | 0.096 | 0.090 | 0.029 | 0.0008 | 0.010 | 0.0008 |
| 6535.3 | B | B | CNISRA | 332 | 29 | 0.102 | 0.039 | 0.028 | 0.0010 | 0.011 | 0.0008 |
| 6101.10 | B | B | CNISRG | 332 | 30 | 0.124 | 0.104 | 0.024 | 0.0010 | 0.003 | 0.0008 |

Figure 33 continued

| Virus ID | Clade or CRF | Clade | 331-336 | N332 glycan | LengthV1 | DH270.1 | DH270.5 | DH270.6 | | 10-1074 | PGT128 | PGT121 |
|---|---|---|---|---|---|---|---|---|---|---|---|---|
| CNE12 | B | B | CNLSRA | 332 | 26 | 0.128 | 0.083 | 0.049 | | 0.0010 | 0.016 | 0.032 |
| CNE57 | B | B | CNLSIA | 332 | 20 | 0.135 | 0.081 | 0.048 | | 0.006 | 0.008 | 0.005 |
| Bal.01 | B | B | CNLSRA | 332 | 31 | 0.176 | 0.131 | 0.045 | | 0.003 | 0.117 | 0.0059 |
| TRO.11 | B | B | CNISRT | 332 | 32 | 0.189 | 0.116 | 0.044 | | 0.0010 | 0.019 | 0.0016 |
| BaL.26 | B | B | CNLSRA | 332 | 31 | 0.221 | 0.113 | 0.060 | | 0.004 | 0.030 | 0.010 |
| 89.6.DG | B | B | CNISRA | 332 | 29 | 0.267 | 0.321 | 0.035 | | 0.002 | 0.010 | 0.037 |
| 7165.18 | B | B | CNLSRA | 332 | 27 | 0.281 | 0.163 | 0.068 | | 0.008 | 0.012 | 0.014 |
| RHPA7 | B | B | CNISRE | 332 | 23 | 0.285 | 0.116 | 0.059 | | 0.007 | 0.032 | 0.010 |
| PVO.04 | B | B | CNLSRA | 332 | 31 | 0.447 | 0.299 | 0.079 | | 0.044 | 0.013 | 0.113 |
| ADA.DG | B | B | CNISRT | 332 | 24 | 0.463 | 0.231 | 0.030 | | 0.003 | 0.010 | 0.031 |
| YU2.DG | B | B | CNLSKT | 332 | 26 | 0.634 | 0.524 | 0.135 | | 0.059 | 0.085 | 0.079 |
| SC422.8 | B | B | CNLSSA | 332 | 24 | 0.646 | 0.321 | 0.062 | | 0.043 | 0.384 | 0.165 |
| X2278.C2.B6 | B | B | CNISAT | 332 | 29 | 0.855 | 0.108 | 0.036 | | 0.015 | 0.012 | 0.004 |
| JRCSF.JB | B | B | CNISRA | 332 | 25 | 1.17 | 0.100 | 0.046 | | 0.004 | 0.011 | 0.020 |
| AC10.29 | B | B | CNISRQ | 332 | 27 | 1.18 | 0.025 | 0.018 | | 0.025 | 0.010 | 0.029 |
| QH0692.42 | B | B | CNLSSV | 332 | 31 | 3.96 | 1.40 | 0.212 | | 0.185 | 0.039 | 0.891 |
| TRJO.58 | B | B | CNISEA | 332 | 34 | >50 | 0.335 | 0.137 | | 0.098 | 0.019 | 7.82 |
| CNE4 | B | B | CNLSST | 332 | 38 | >50 | 23.9 | 2.99 | | 0.102 | 0.898 | 6.42 |
| QH0515.01 | B | B | CNLSRA | 332 | 28 | >50 | >50 | 0.907 | | 0.200 | >50 | 9.88 |
| CNE10 | B | B | CNLSRT | 332 | 21 | >50 | >50 | 10.1 | | 0.0009 | 0.010 | 0.0006 |
| BL01.DG | B | B | CNLSRA | 332 | 25 | >50 | >50 | 16.5 | | 5.28 | >50 | >25 |
| BR07.DG | B | B | CNLSRT | 332 | 27 | >50 | >50 | >50 | | 0.015 | 0.636 | 0.396 |
| WITO.33 | B | B | CNISTE | 332 | 25 | >50 | >50 | >50 | | 0.213 | >50 | 0.705 |
| HT593.1 | B | B | CNISRA | 332 | [illegible] | >50 | >50 | >50 | | 0.704 | >50 | >25 |
| MN.3 | B | B | CNISRA | 332 | 33 | >50 | >50 | >50 | | 1.29 | >50 | >25 |
| HXB2.DG | B | B | CNISRA | 332 | 27 | >50 | >50 | >50 | | 3.91 | >50 | >25 |
| REJO.67 | B | B | CTINES | 334 | 29 | >50 | >50 | >50 | | >50 | >50 | 13.3 |
| BG1168.01 | B | B | CTLNST | 334 | [illegible] | >50 | >50 | >50 | | >50 | >50 | >25 |
| HO86.8 | B | B | CNVNKT | 334 | 23 | >50 | >50 | >50 | | >50 | >50 | >25 |
| THRO.18 | B | B | CTVNGT | 334 | 35 | >50 | >50 | >50 | | >50 | >50 | >25 |
| 5768.04 | B | B | CNINRA | none | 27 | >50 | 5.23 | 0.164 | | 0.314 | 1.41 | 0.293 |
| 57128.vrc15 | D | D | CNISRK | 332 | 33 | 17.4 | 28.0 | 2.40 | | 0.252 | 0.059 | 2.60 |
| 6405.v4.c34 | D | D | CNVSRV | 332 | 30 | >50 | >50 | 2.88 | | 0.007 | 1.63 | 0.006 |
| A07412M1.vrc12 | D | D | CNVSKV | 332 | 25 | >50 | >50 | >50 | | 0.0003 | 24.7 | 0.013 |
| A03349M1.vrc4a | D | D | CNISGA | 332 | 20 | >50 | >50 | >50 | | 0.010 | 0.019 | 0.025 |
| 231965.c1 | D | D | CNISRK | 332 | 36 | >50 | >50 | >50 | | [illegible] | >50 | >25 |
| UG021.16 | D | D | CNISGE | 332 | 21 | >50 | >50 | >50 | | 0.068 | >50 | 2.49 |
| 191821.E6.1 | D | D | CNVSRT | 332 | 17 | >50 | >50 | 6.91 | | >50 | 0.035 | >25 |
| UG024.2 | D | D | CNISEA | 332 | 27 | >50 | >50 | >50 | | 0.111 | >50 | >25 |
| NKU3006.ec1 | D | D | CEINGT | 334 | 41 | >50 | >50 | >50 | | >50 | >50 | >25 |
| 3016.v5.c45 | D | D | CTIDGT | none | 23 | >50 | >50 | >50 | | >50 | >50 | >25 |
| P1981.C5.3 | G | G | CNISKS | 332 | 21 | 0.047 | 0.038 | 0.015 | | 0.0003 | 0.015 | 0.0001 |

Figure 33 continued

| Virus ID | Clade or CRF | Clade | 331-336 | N332 glycan | LengthV1 | DH270.1 | DH270.5 | DH270.6 | 10-1074 | PGT128 | PGT121 |
|---|---|---|---|---|---|---|---|---|---|---|---|
| **X2088.c9** | G | G | CNVTRG | 332 | 15 | 0.158 | 0.033 | 0.022 | 0.0003 | >50 | 0.0005 |
| **X1254.c3** | G | G | CNISGT | 332 | 26 | 0.259 | 0.174 | 0.076 | 0.037 | 0.023 | 0.009 |
| **X2131.C1.B5** | G | G | CNISKT | 332 | 30 | 0.972 | 0.197 | 0.096 | 0.021 | 0.023 | 0.003 |
| **P0402.c2.11** | G | G | CNISGA | 332 | 24 | 14.8 | 2.81 | 0.107 | 0.006 | 0.007 | 0.0007 |
| **X1193.c1** | G | G | CNISKT | 332 | 30 | 31.2 | 1.19 | 0.213 | 0.036 | 0.020 | 0.019 |
| **X1632.S2.B10** | G | G | CNINGS | 334 | 27 | >50 | >50 | >50 | >50 | >50 | >25 |
| **3817.v2.c59** | unique | CD | CNISRG | 332 | 23 | 0.736 | 0.856 | 0.332 | 0.308 | 0.017 | >25 |
| **3337.V2.C6** | unique | CD | CNISAT | 332 | 18 | 34.0 | 6.88 | 0.305 | 0.008 | 0.004 | 8.10 |
| **T280-5** | unique | AG | CNVSKA | 332 | 17 | 0.044 | 0.015 | 0.034 | 0.0003 | 0.014 | 0.003 |
| **CH038.12** | unique | BC | CNISRE | 332 | 26 | 0.217 | 0.093 | 0.039 | 0.0010 | 0.007 | 0.002 |
| **0815.V3.C3** | unique | ACD | CNVSRA | 332 | 28 | 0.635 | 0.508 | 0.131 | 0.008 | 0.025 | 0.016 |
| **CH070.1** | unique | 07C | CNISKD | 332 | 40 | 0.621 | 0.310 | 0.061 | 0.0010 | 0.028 | 0.010 |
| **3589.V1.C4** | unique | AC | CNVSRT | 332 | 23 | >50 | >50 | >50 | >50 | 0.008 | >25 |
| **CNE7** | unique | BC | CNIS-- | 332 | 22 | >50 | >50 | >50 | 0.048 | 0.034 | 0.013 |
| **CNE40** | unique | BC | CNISRS | 332 | 33 | >50 | >50 | >50 | 0.964 | >50 | 0.321 |
| **6095.V1.C10** | unique | ACD | CNISSK | 332 | 20 | >50 | >50 | >50 | >50 | >50 | >25 |
| **3468.V1.C12** | unique | AD | CNVSGT | 332 | 27 | >50 | >50 | >50 | 0.0007 | >50 | 0.347 |
| **3326.V4.C3** | unique | CD | CNINGT | 334 | 19 | >50 | >50 | >50 | >50 | >50 | >25 |
| **6540.v4.c1** | unique | AC | CTVNRT | 334 | 25 | >50 | >50 | >50 | >50 | 0.816 | >25 |
| **6545.V4.C1** | unique | AC | CTVNRT | 334 | 25 | >50 | >50 | >50 | >50 | >50 | >25 |
| **246-F3.C10.2** | unique | AC | CTVNKT | 334 | 22 | >50 | >50 | >50 | >50 | 0.003 | >25 |
| **247-23** | unique | DU | CTINKT | 334 | 21 | >50 | >50 | >50 | >50 | >50 | >25 |
| **Q168.a2** | unique | AD | CTVNGS | 334 | 24 | >50 | >50 | >50 | >50 | >50 | >25 |
| **CNE15** | unique | BC | CSINAG | none | 23 | >50 | >50 | >50 | >50 | >50 | >25 |
| **BR025.9** | C | C | CNISRT | 332 | 22 | 0.060 | 0.029 | 0.015 | 0.0003 | 0.005 | 0.0016 |
| **SO18.18** | C | C | CNISES | 332 | 17 | 0.073 | 0.039 | 0.015 | 0.0007 | 0.041 | 0.0005 |
| **286.36** | C | C | CNISRE | 332 | 22 | 0.119 | 0.069 | 0.027 | 0.0003 | 0.011 | 0.0009 |
| **ZM106.9** | C | C | CNISEE | 332 | 25 | 0.127 | 0.078 | 0.031 | 0.0010 | 0.025 | 0.0007 |
| **6644.V2.C33** | C | C | CNISAS | 332 | 34 | 0.126 | 0.035 | 0.033 | 0.002 | 0.008 | 0.012 |
| **CAP256.206.C9** | C | C | CNISEI | 332 | 22 | 0.128 | 0.034 | 0.043 | 0.030 | 0.018 | 0.003 |
| **MW965.26** | C | C | CNISTI | 332 | 26 | 0.135 | 0.031 | 0.019 | 0.0010 | 0.179 | 0.0008 |
| **ZM55.28a** | C | C | CNISIE | 332 | 13 | 0.145 | 0.074 | 0.052 | 0.002 | 0.024 | 0.046 |
| **288.38** | C | C | CNISGD | 332 | 32 | 0.148 | 0.114 | 0.048 | 0.0007 | 0.011 | 0.004 |
| **25711-2.4** | C | C | CNISEG | 332 | 26 | 0.200 | 0.044 | 0.021 | 0.0010 | 0.016 | 0.011 |
| **DU156.12** | C | C | CNISRN | 332 | 25 | 0.234 | 0.126 | 0.055 | 0.0010 | 0.020 | 0.002 |
| **6785.V5.C14** | C | C | CNISAR | 332 | 25 | 0.247 | 0.138 | 0.050 | 0.004 | 0.016 | 0.015 |
| **Ce1176.A3** | C | C | CNVSKQ | 332 | 23 | 0.294 | 0.222 | 0.038 | 0.024 | 0.015 | 0.004 |
| **3873.V1.C24** | C | C | CNISGA | 332 | 29 | 0.374 | 0.100 | 0.042 | 0.019 | 0.015 | 0.133 |
| **CNE53** | C | C | CNISES | 332 | 20 | 0.406 | 0.272 | 0.143 | 0.002 | 0.030 | 0.003 |
| **CE703010217.B6** | C | C | CNISEK | 332 | 17 | 0.457 | 0.078 | 0.040 | 0.304 | 0.043 | 0.0007 |
| **DU123.06** | C | C | CNISKT | 332 | 30 | 0.531 | 0.238 | 0.175 | 0.072 | 0.061 | 0.033 |
| **DU422.01** | C | C | CNISRE | 332 | 27 | 0.554 | 0.243 | 0.120 | 0.027 | 0.064 | 0.022 |

Figure 33 continued

| Virus ID | Clade or CRF | Clade | 331-336 | N332 glycan | LengthV1 | DH270.1 | DH270.5 | DH270.6 | | 10-1074 | PGT128 | PGT121 |
|---|---|---|---|---|---|---|---|---|---|---|---|---|
| **96ZM651.02** | C | C | CNISRT | 332 | 32 | 0.660 | 0.103 | 0.027 | | 0.002 | 0.026 | 0.0010 |
| **16936-2.21** | C | C | CNISEA | 332 | 21 | 0.725 | 0.380 | 0.072 | | 0.0003 | 0.023 | 0.002 |
| **3168.V4.C10** | C | C | CNISEK | 332 | 29 | 0.856 | 1.16 | 0.440 | | 0.391 | >50 | 0.453 |
| **3301.V1.C24** | C | AC | CNITRN | 332 | 21 | 0.587 | 0.331 | 0.105 | | 0.0010 | 0.131 | 0.007 |
| **TZBD.02** | C | C | CNISKD | 332 | 29 | 1.82 | 0.081 | 0.027 | | 0.0010 | >50 | 0.0001 |
| **25710-2.43** | C | C | CNISKD | 332 | 16 | 2.07 | 0.383 | 0.120 | | 0.011 | 0.020 | 0.019 |
| **ZM135.10a** | C | C | CNISGE | 332 | 23 | 2.12 | 0.302 | 0.122 | | 0.052 | >50 | 1.94 |
| **CNE58** | C | C | CNITKS | 332 | 39 | 2.20 | 0.325 | 0.250 | | 0.087 | 0.988 | >25 |
| **CNE30** | C | C | CNISRN | 332 | 25 | 3.02 | 1.84 | 0.742 | | 0.222 | 0.269 | 0.068 |
| **ZM215.8** | C | C | CNISKK | 332 | 17 | 5.13 | 0.361 | 0.161 | | 0.004 | 0.045 | 0.011 |
| **TV1.29** | C | C | CNISTD | 332 | 33 | 8.94 | 1.62 | 0.670 | | 0.410 | 0.122 | 0.035 |
| **ZA012.29** | C | C | CNISES | 332 | 21 | 9.33 | 0.125 | 0.066 | | 0.0010 | 0.040 | 0.0008 |
| **DU172.17** | C | C | CNISRK | 332 | 30 | 13.8 | 1.39 | 0.300 | | 0.016 | 0.041 | 0.030 |
| **ZM214.15** | C | C | CNISKD | 332 | 28 | 40.8 | 6.22 | 0.563 | | 0.491 | 0.522 | 1.03 |
| **426c** | C | C | CNTSGL | 332 | 29 | >50 | 0.916 | 0.197 | | 0.068 | >50 | >25 |
| **6471.V1.C16** | C | C | CNISKV | 332 | 33 | >50 | 3.43 | 0.429 | | 0.827 | >50 | >25 |
| **ZM176.66** | C | C | CNISEE | 332 | 27 | >50 | 8.01 | 0.504 | | 0.209 | 0.026 | 15.4 |
| **25925-2.22** | C | C | CNISRD | 332 | 19 | >50 | 8.78 | 0.519 | | 0.0010 | 0.016 | 0.032 |
| **16845-2.22** | C | C | CNISEA | 332 | 33 | >50 | 13.1 | 1.12 | | 0.316 | 0.121 | 7.98 |
| **DU151.02** | C | C | CNISKS | 332 | 18 | >50 | 24.6 | 0.820 | | 0.0008 | 0.010 | 0.002 |
| **0921.V2.C14** | C | C | CNISKH | 332 | 13 | >50 | >50 | 3.86 | | >50 | >50 | >25 |
| **CAP244.D3** | C | C | CNIDKG | 332 | 42 | >50 | >50 | 5.23 | | 41.1 | >50 | >25 |
| **001428-2.42** | C | C | CNISEK | 332 | 27 | >50 | >50 | 14.2 | | 0.008 | 0.037 | 0.007 |
| **ZM233.6** | C | C | CNISAS | 332 | 17 | >50 | >50 | >50 | | 0.003 | >50 | 2.13 |
| **26191-2.48** | C | C | CNISKE | 332 | 17 | >50 | >50 | >50 | | 0.010 | 0.019 | 0.091 |
| **6631.V3.C10** | C | C | CNISRE | 332 | 39 | >50 | >50 | >50 | | 0.158 | 1.25 | >25 |
| **CNE31** | C | C | CNISEE | 332 | 25 | >50 | >50 | >50 | | 0.348 | >50 | 0.947 |
| **TZA125.17** | C | C | CNISRS | 332 | 29 | >50 | >50 | >50 | | 1.77 | 0.511 | 5.55 |
| **0013095-2.11** | C | C | CNISEE | 332 | 24 | >50 | >50 | >50 | | 5.84 | >50 | >25 |
| **ZM249.1** | C | C | CNISKE | 332 | 23 | >50 | >50 | >50 | | >50 | 0.363 | >25 |
| **ZM109.4** | C | C | CKINGS | 332 | 17 | >50 | >50 | >50 | | >50 | >50 | 11.7 |
| **3637.V5.C3** | C | C | CNISKG | 332 | 18 | >50 | >50 | >50 | | >50 | >50 | >25 |
| **CAP210.E8** | C | C | CNISEK | 332 | 19 | >50 | >50 | >50 | | >50 | >50 | >25 |
| **CAP45.G3** | C | C | CNINNS | 334 | 17 | >50 | >50 | >50 | | >50 | >50 | 1.74 |
| **0077_V1.C16** | C | C | CNINES | 334 | 29 | >50 | >50 | >50 | | >50 | >50 | >25 |
| **6322.V4.C1** | C | C | CKINGT | 334 | 25 | >50 | >50 | >50 | | >50 | >50 | >25 |
| **6838.V1.C35** | C | C | CTIETE | none | 23 | >50 | >50 | >50 | | 0.611 | >50 | 0.033 |
| **ZM53.12** | C | C | CIINKA | none | 15 | >50 | >50 | >50 | | >50 | >50 | 0.0001 |
| **16055-2.3** | C | C | CNIKKD | none | 24 | >50 | >50 | >50 | | >50 | >50 | 1.18 |
| **00836-2.5** | C | C | CDISED | none | 22 | >50 | >50 | >50 | | >50 | >50 | >25 |
| **ZM197.7** | C | C | CDLSKS | none | 33 | >50 | >50 | >50 | | >50 | >50 | >25 |
| | | | | | | | | | | | | |
| SIVmac251.30.SG3 | neg control | | | | | >50 | >50 | >50 | | >50 | >50 | >25 |
| SVA.MLV | neg controal | | | | | >50 | >50 | >50 | | >50 | >50 | >25 |

Figure 33 continued

Column B:
Clade or CRF
Clade designation used in Figs. 1 and 2. CRF's refer to circulating recombinant forms (see: http://www.hiv.lanl.gov/content/sequence/HIV/CRFs/CRFs.html, April 2016, for a complete description)

Reassigned clades in this panel are indicated below:

Here is why we altered some designations:

| | |
|---|---|
| **CH070.1** | This was previously designated BC, but our analysis indicated it was a CRF07/C recombinant, which would be all C in Env. |
| **247-23** | This was previously designated D, but our analysis indicated it was only part D-like, part a recombinant with a virus of unknown origin, very dissimilar to D and to other strains in Env |
| **3301.V1.C24** | This is sometimes designated AC, but designated C in the database and here; it has a short possible A like region near the 5' end, hence the ambiguity |
| **Q461.e2 AD A** | This is sometimes designated AD, but designated A in the database and here; it has a short possible D like region near the 5' end, hence the ambiguity |

Column C: Clade: Parental clades associated with the virus.

CRF01 is an AE recombinant that is essentially E in Env, and very common in parts of Asia
CRF02 is a AG recombinant, that is essentially A in Env, and common in West and Central Africa CRF07is a BC recombinant that is essentially C in Env, and common in China

Column D: Positions 331-336

These are the amino acids for each virus (based on HXB2 numbering) in positions that frame the key glycosylations site at 332.
A potential N-linked glycosylation sites requires the sequence motif: Nx[ST], where N is followed by "x", any amino acids except proline, and then by a Ser or Thr.

C331 is the perfectly preserved Cys the closes the V3 loop in HIV-1
The critical glycosylation site for V3 glycan antibodies is at N332 -- the DH270 lineage requires it, other V3 glycan antibodies tend to prefer it.
The site is lost by 2 common mechanisms: The [ST] in the third position of the motif changed to an N, shifting the glycosylation site to N334, or the complete loss of either site.

Column E:
N332 glycan

Based on the amino acid patterns in Column D, one of three outcomes in indicated

| | |
|---|---|
| 332 | The N332 glycosyation site is intact |
| 334 | The N332 site is lost and shifted to N334 |
| none | No glycosylation site is found at either 332 or 334. |

Column F: Length V1: The number of amino acids within the V1 loop region.

Shorter loops are associated with greater potency and required for senstivity by early antibodies in the lineage

| |
|---|
| <21 |
| 21 to 30 |
| 31 - 40 |
| >40 |

Columns G-I: IC50 values for antibodies in the DH270 lineage using the TZM bl assay to explore heterologous reactivity.

Figure 33 continued

Columns K-M: IC50 values for antibodies iolsated from other subjects that also recognize the V3 glycan epitope.

| | |
|---|---|
| < 0.1 | |
| 0.1 to <1 | |
| 1 to < 10 | |
| 10 to 50 | |
| >50 | Above the threshold of detection |

Figure 34

| Virus ID | Clade or CRF | N332 glycan | Length V1* | DH270.UCA | DH270.IA4 | DH270.IA3 | DH270.3 | DH270.IA2 | DH270.1 |
|---|---|---|---|---|---|---|---|---|---|
| 92RW020.2 | A | 332 | 15 | >50 | 0.282 | 0.058 | 0.038 | 0.033 | 0.024 |
| Q23.17 | A | 332 | 19 | >50 | 15.3 | 0.227 | 0.128 | 0.071 | 0.066 |
| ZM55F.PB28a | C | 332 | 13 | >50 | 37.8 | 0.998 | 0.677 | 0.121 | 0.089 |
| 6101.10 | B | 332 | 30 | >50 | 1.77 | 0.225 | 0.341 | 0.119 | 0.116 |
| JR-FL | B | 332 | 25 | >50 | >50 | 5.31 | 0.109 | 0.237 | 0.082 |
| ZM106F.PB9 | C | 332 | 25 | >50 | >50 | 6.83 | 0.255 | 0.315 | 0.147 |
| DU156.12 | C | 332 | 25 | >50 | >50 | 1.97 | 1.46 | 0.527 | 0.25 |
| TRO.11 | B | 332 | 32 | >50 | >50 | 0.686 | 1.51 | 0.226 | 0.173 |
| YU2 | B | 332 | 26 | >50 | >50 | 4.22 | 2.07 | 0.443 | 0.395 |
| DJ263.8 | CRF02.AG | 332 | 36 | >50 | >50 | >50 | >50 | 0.734 | 0.374 |
| CAAN5342.A2 | B | 332 | 24 | >50 | >50 | >50 | >50 | 2.78 | 0.109 |
| DU422.1 | C | 332 | 27 | >50 | >50 | >50 | 46.7 | >50 | 0.891 |
| PVO.4 | B | 332 | 31 | >50 | >50 | >50 | >50 | >50 | 0.41 |
| CNE58 | C | 332 | 39 | >50 | >50 | >50 | >50 | >50 | 3.01 |
| TRJO4551.58 | B | 332 | 34 | >50 | >50 | >50 | >50 | >50 | >50 |
| DU172.17 | C | 332 | 30 | >50 | >50 | >50 | >50 | >50 | 49.8 |
| 57128.vrc15 | D | 332 | 33 | >50 | >50 | >50 | >50 | >50 | >50 |
| C1080.c03 | CRF01.AE | 334 | 28 | >50 | >50 | >50 | >50 | >50 | >50 |
| 6540.v4.c1 | AC | 334 | 25 | >50 | >50 | >50 | >50 | >50 | >50 |
| Q168.a2 | AD | 334 | 24 | >50 | >50 | >50 | >50 | >50 | >50 |
| BG1168.1 | B | 334 | 42 | >50 | >50 | >50 | >50 | >50 | >50 |
| THRO4156.18 | B | 334 | 35 | >50 | >50 | >50 | >50 | >50 | >50 |
| X1632-S2-B10 | G | 334 | 27 | >50 | >50 | >50 | >50 | >50 | >50 |
| Q769.d22 | A | none | 24 | >50 | >50 | >50 | >50 | >50 | >50 |

Figure 34 continued

| Virus ID | DH270.2 | DH270.IA1 | DH270.4 | DH270.5 | DH270.6 | DH272 | DH475 | CH01+CH31 |
|---|---|---|---|---|---|---|---|---|
| 92RW020.2 | 0.022 | 0.014 | 0.016 | 0.052 | 0.021 | >50 | >50 | 1.672 |
| Q23.17 | 0.056 | 0.035 | 0.036 | 0.049 | 0.03 | 9.802 | >50 | 0.078 |
| ZM55F.PB28a | 0.071 | 0.068 | 0.093 | 0.074 | 0.05 | >50 | >50 | 2.87 |
| 6101.10 | 0.079 | 0.035 | 0.031 | 0.104 | 0.04 | >50 | >50 | >25 |
| JR-FL | 0.039 | 0.011 | 0.016 | 0.033 | 0.04 | >50 | >50 | 0.916 |
| ZM106F.PB9 | 0.083 | 0.047 | 0.052 | 0.078 | 0.05 | >50 | >50 | 11.577 |
| DU156.12 | 0.202 | 0.093 | 0.115 | 0.126 | 0.07 | >50 | >50 | 0.591 |
| TRO.11 | 0.121 | 0.089 | 0.079 | 0.116 | 0.06 | >50 | >50 | 0.256 |
| YU2 | 0.215 | 0.075 | 0.074 | 0.524 | 0.06 | >50 | >50 | 0.072 |
| DJ263.8 | 0.158 | 0.076 | 0.027 | 0.128 | 0.08 | >50 | >50 | 0.36 |
| CAAN5342.A2 | 0.197 | 0.05 | 0.044 | 0.106 | 0.03 | >50 | >50 | 0.089 |
| DU422.1 | 0.486 | 0.225 | 0.266 | 0.243 | 0.19 | >50 | >50 | 0.025 |
| PVO.4 | 0.618 | 0.115 | 0.138 | 0.299 | 0.14 | >50 | >50 | 0.095 |
| CNE58 | 2.04 | 0.343 | 0.483 | 0.325 | 0.28 | >50 | >50 | 0.245 |
| TRJO4551.58 | 5.35 | 0.216 | 0.127 | 0.335 | 0.16 | >50 | >50 | 0.307 |
| DU172.17 | >50 | 0.877 | 0.701 | 1.39 | 0.27 | >50 | >50 | >50 |
| 57128.vrc15 | >50 | >50 | >50 | 23 | 2 | >50 | >50 | 0.574 |
| C1080.c03 | >50 | >50 | >50 | >50 | >50 | >50 | >50 | >25 |
| 6540.v4.c1 | >50 | >50 | >50 | >50 | >50 | >50 | >50 | 0.458 |
| Q168.a2 | >50 | >50 | >50 | >50 | >50 | >50 | >50 | 0.015 |
| BG1168.1 | >50 | >50 | >50 | >50 | >50 | >50 | >50 | 0.141 |
| THRO4156.18 | >50 | >50 | >50 | >50 | >50 | >50 | >50 | 2.816 |
| X1632-S2-B10 | >50 | >50 | >50 | >50 | >50 | >50 | >50 | 0.086 |
| Q769.d22 | >50 | >50 | >50 | >50 | >50 | >50 | >50 | 0.033 |

IC50 neturalization scores for a series of antibodies from the DH270 lineage tested against a panel of 24 Tier 2 HIV-1 pseudo viruses in the TZMbl assay.
*Note that having a N332 PNG site was critical to outome, and that sensitivity to early antibodies in the lineage was associated with short V1 loops.

Column B: Clade or CRF: Clade designation used in Figs. 1 and 2

Column C: N332 glycan

Based on the amino acid patterns in Column D, one of three outcomes in indicated

| | |
|---|---|
| 332 | The N332 glycosyation site is intact |
| 334 | The N332 site is lost and shifted to N334 |
| none | No glycosylation site is found at either 332 or 334. |

Figure 34 continued

Column D: Length V1: The number of amino acids within the V1 loop region.

Shorter loops are associated with greater potency and required for senstivity by early antibodies in the lineage

| |
|---|
| <21 |
| 21 to 30 |
| 31 < 40 |
| >40 |

Columns E-O: IC50 values for antibodies in the DH270 lineage using the TZMbl assay to explore heterologous reactivity.
Columns P, Q: IC50 values for antibodies DH272 and DH475 isolated from the same subject that also recognize the V3 glycan epitope but do not belong to the DH270 lineage.
Column R: IC50 values for positive control antibodies CH01, a V2 glycan broadly neutralizing antibody, and CH31 a CD4bs broadly neutralizing antibody.

| | |
|---|---|
| < 0.1 | |
| 0.1 to <1 | |
| 1 to < 10 | |
| 10 to 50 | |
| >50 | Above the threshold of detection |
| NA | Not tested |

Figure 35

| | Autologous gp120 Binding Data | | | | | | | | | | | | |
|---|---|---|---|---|---|---|---|---|---|---|---|---|---|
| | | | | | | | wk 205 | | wk 232 | wk 232 | wk234 | wk 205 | wk 232 |
| Subject.day.clone | DH272 | DH475 | DH270.UCA | DH270.IA4 | DH270.IA3 | DH270.IA2 | DH270.I | DH270.IA1 | DH270.4 | DH270.5 | DH270.6 | DH270.3 | DH270.2 |
| CH848.0000.TF | 1.155 | 13.549 | 0 | 0 | 0 | 0 | 8.909 | 14.244 | 13.549 | 13.469 | 14.807 | 10.025 | 10.69 |
| CH848.0078.30.02 | 0.589 | 13.315 | 0 | 0 | 0 | 0 | 2.674 | 8.519 | 13.816 | 11.105 | 10.423 | 3.194 | 8.023 |
| CH848.0078.30.42 | 0.327 | 12.57 | 0 | 0 | 0 | 0 | 10.109 | 6.335 | 13.426 | 10.359 | 13.214 | 8.062 | 7.636 |
| CH848.0107.30.12 | 1.159 | 10.256 | 0 | 0 | 0 | 0 | 4.137 | 5.834 | 12.791 | 9.877 | 11.765 | 4.642 | 5.183 |
| CH848.0107.30.27 | 0.391 | 12.937 | 0 | 0 | 0 | 0 | 9.712 | 8.718 | 13.964 | 11.25 | 13.5 | 10.391 | 8.565 |
| CH848.0107.30.31 | 0.157 | 12.203 | 0 | 0 | 0 | 0 | 8.756 | 8.657 | 12.003 | 6.603 | 13.399 | 9.155 | 1.795 |
| CH848.0135.27.03 | | | | | | | | | | | | | |
| CH848.0135.27.06 | 0.12 | 15.15 | 0 | 0 | 0 | 0 | 11.615 | 9.242 | 14.151 | 11.406 | 13.632 | 9.014 | 9.677 |
| CH848.0135.60.05 | 0.439 | 12.284 | 0 | 0 | 0 | 0 | 10.101 | 9.306 | 14.29 | 11.809 | 12.779 | 10.349 | 9.78 |
| CH848.0135.60.14 | 0.351 | 12.931 | 0 | 0 | 0 | 0 | 12.733 | 14.628 | 16.776 | 14.405 | 14.543 | 11.497 | 14.619 |
| CH848.0135.60.19 | 0.392 | 13.775 | 0 | 0 | 0 | 0 | 10.309 | 11.97 | 14.636 | 10.961 | 13.869 | 9.95 | 8.167 |
| CH848.0135.60.20 | 0.357 | 14.234 | 0 | 0 | 0 | 0 | 9.064 | 13.778 | 16.538 | 12.811 | 14.004 | 9.057 | 12.346 |
| CH848.0135.60.32 | 0.651 | 12.798 | 0 | 0 | 0 | 0 | 4.452 | 10.233 | 13.773 | 12.256 | 13.782 | 7.745 | 9.12 |
| CH848.0135.60.34 | 0.377 | 15.642 | 0 | 0 | 0.088 | 0 | 5.599 | 10.58 | 13.576 | 11.43 | 13.899 | 7.505 | 7.917 |
| CH848.0194.25.17 | 1.625 | 9.807 | 0 | 0 | 0 | 0 | 7.477 | 12.496 | 14.715 | 12.212 | 12.63 | 7.843 | 10.506 |
| CH848.0194.25.21 | 0.255 | 8.705 | 0 | 0 | 0 | 0 | 7.532 | 10.992 | 13.806 | 11.218 | 11.911 | 6.883 | 9.655 |
| CH848.0194.25.24 | 0.15 | 13.849 | 0 | 0 | 0 | 0 | 10.911 | 12.025 | 14.933 | 10.99 | 13.929 | 10.368 | 8.513 |
| CH848.0194.25.48 | 0.687 | 14.116 | 0 | 0 | 0 | 0.081 | 11.173 | 14.131 | 16.276 | 12.983 | 14.203 | 9.849 | 12.02 |
| CH848.0274.30.02 | 0.141 | 13.637 | 0 | 0 | 0 | 0 | 8.542 | 12.814 | 15.26 | 13.575 | 13.768 | 8.58 | 10.84 |
| CH848.0274.30.07 | 0.198 | 14.476 | 0 | 0 | 0 | 0 | 12.378 | 13.489 | 15.075 | 14.803 | 14.371 | 11.512 | 12.235 |
| CH848.0274.30.09 | 1.907 | 10.068 | 0 | 0 | 0 | 0 | 8.087 | 13.87 | 14.297 | 14.773 | 14.07 | 9.643 | 12.778 |
| CH848.0274.30.14 | 1.202 | 8.162 | 0 | 0 | 0 | 0 | 9.097 | 12.633 | 13.815 | 13.451 | 13.558 | 10.092 | 13.038 |
| CH848.0358.80.03 | 0.145 | 5.612 | 0 | 0 | 0 | 0 | 9.693 | 13.888 | 14.564 | 14.878 | 13.537 | 9.783 | 14.196 |
| CH848.0358.80.06 | 1.189 | 8.276 | 0 | 0 | 0 | 0.284 | 11.203 | 13.456 | 14.866 | 14.991 | 13.899 | 11.122 | 14.558 |
| CH848.0358.80.17 | 0.528 | 8.157 | 0 | 0 | 0 | 0 | 9.226 | 13.599 | 14.465 | 14.629 | 13.245 | 9.631 | 13.293 |
| CH848.0358.80.44 | 0.525 | 7.732 | 0 | 0 | 0 | 0.099 | 10.495 | 13.91 | 14.455 | 14.802 | 13.875 | 10.342 | 14.195 |
| CH848.0445.25.04 | 0.2 | 7.868 | 0 | 0 | 0 | 0 | 10.396 | 12.357 | 13.912 | 14.202 | 14.323 | 10.505 | 13.368 |
| CH848.0445.25.18 | 0.361 | 11.239 | 0 | 0 | 1.469 | 0 | 8.756 | 13.323 | 14.938 | 14.646 | 13.337 | 9.127 | 13.593 |
| CH848.0445.25.26 | 1.172 | 7.876 | 0 | 0 | 0 | 0 | 11.781 | 13.911 | 14.358 | 14.954 | 14.594 | 11.667 | 14.197 |
| CH848.0445.30.41 | 0.112 | 8.839 | 0 | 0 | 0 | 0 | 7.311 | 10.781 | 12.109 | 12.091 | 12.654 | 7.04 | 10.905 |
| CH848.0445.30.42 | 0.551 | 8.706 | 0 | 0 | 0 | 0 | 9.262 | 13.358 | 14.464 | 14.761 | 14.104 | 9.889 | 13.094 |

Figure 35 continued

| | | | | | | | | | | | | | |
|---|---|---|---|---|---|---|---|---|---|---|---|---|---|
| CH848.0526.25.02 | 0.104 | 7.02 | 0 | 0 | 0 | 0 | 8.821 | 11.957 | 13.561 | 13.794 | 13.628 | 9.888 | 12.58 |
| CH848.0526.25.09 | 0.091 | 7.874 | 0 | 0 | 0 | 0 | 4.326 | 12.187 | 14.065 | 13.574 | 11.551 | 7.18 | 12.3 |
| CH848.0526.25.10 | 0.102 | 6.492 | 0 | 0 | 0 | 0 | 7.786 | 12.924 | 13.424 | 13.533 | 13.143 | 7.746 | 12.705 |
| CH848.0526.25.11 | 0.206 | 6.889 | 0 | 0 | 0 | 0.304 | 10.851 | 14.16 | 14.664 | 15.437 | 14.218 | 8.912 | 13.769 |
| CH848.0526.25.21 | 0.522 | 6.881 | 0 | 0 | 0 | 0.111 | 10.69 | 13.559 | 14.249 | 15.101 | 13.458 | 10.082 | 13.921 |
| CH848.0526.25.26 | 0.867 | 7.295 | 0 | 0 | 0 | 0.118 | 10.876 | 14.078 | 15.638 | 14.069 | 13.151 | 9.551 | 13.895 |
| CH848.0526.25.32 | 0 | 5.914 | 0 | 0 | 0 | 0 | 6.529 | 11.176 | 12.661 | 11.756 | 12.154 | 6.692 | 11.034 |
| CH848.0526.25.39 | 0.205 | 7.713 | 0 | 0 | 0 | 0.196 | 8.835 | 12.356 | 15.669 | 12.943 | 13.515 | 8.967 | 13.899 |
| CH848.0611.09.02 | 0.755 | 5.853 | 0 | 0 | 0 | 0.153 | 9.121 | 14.51 | 16.072 | 14.781 | 12.829 | 9.995 | 15.77 |
| CH848.0611.20.12 | 0.346 | 6.673 | 0 | 0 | 0 | 0.444 | 10.343 | 13.113 | 15.688 | 13.541 | 13.532 | 9.335 | 14.551 |
| CH848.0611.20.14 | 0.256 | 7.209 | 0 | 0 | 0 | 0 | 11.935 | 12.402 | 15.278 | 13.066 | 14.691 | 12.773 | 13.362 |
| CH848.0611.20.28 | 0.262 | 5.535 | 0 | 0 | 0 | 0.284 | 11.604 | 12.983 | 14.367 | 14.145 | 14.76 | 11.208 | 13.671 |
| CH848.0700.15.05 | 0.143 | 7.471 | 0 | 0 | 0 | 0 | 11.761 | 12.785 | 14.931 | 12.506 | 14.038 | 11.691 | 12.114 |
| CH848.0700.15.15 | 0.116 | 6.165 | 0 | 0 | 0 | 0 | 4.91 | 11.497 | 14.424 | 11.984 | 12.435 | 6.341 | 12.103 |
| CH848.0700.15.29 | 0.226 | 6.133 | 0 | 0 | 0 | 0.093 | 10.103 | 14.26 | 15.244 | 15.272 | 13.22 | 10.095 | 13.724 |
| CH848.0700.15.34 | 0.599 | 3.562 | 0 | 0 | 0.722 | 4.95 | 12.286 | 13.584 | 14.806 | 15.647 | 13.353 | 10.66 | 14.864 |
| CH848.0700.27.06 | 0.63 | 0.549 | 0 | 0 | 0.088 | 0 | 8.1 | 11.772 | 12.939 | 12.822 | 13.916 | 8.842 | 10.28 |
| CH848.0700.27.06 | 0.305 | 7.529 | 0 | 0 | 0 | 0 | 3.401 | 8.894 | 10.501 | 8.32 | 13.375 | 5.99 | 8.433 |
| CH848.0780.15.22 | 0 | 3.618 | 0 | 0 | 1.621 | 8.839 | 13.34 | 15.012 | 14.465 | 15.896 | 14.345 | 13.002 | 14.785 |
| CH848.0780.15.22/293VRC | 0 | 5.904 | 0 | 0 | 1.141 | 9.782 | 13.356 | 15.668 | 16.047 | 16.574 | 14.706 | 12.487 | 15.696 |
| CH848.0780.15.29 | 0 | 1.874 | 0 | 0 | 1.206 | 7.257 | 12.594 | 13.202 | 13.053 | 14.192 | 14.319 | 11.211 | 12.993 |
| CH848.0780.25.05 | 0.147 | 7.028 | 0 | 0 | 0 | 0 | 11.075 | 13.816 | 16.068 | 13.814 | 14.059 | 10.58 | 13.859 |
| CH848.0794.03.03 | 0 | 6.282 | 0 | 0 | 0 | 0.097 | 5.29 | 10.834 | 10.767 | 11.34 | 12.376 | 1.496 | 10.442 |
| CH848.0794.05.41 | 0.098 | 6.336 | 0 | 0 | 0.685 | 4.705 | 12.051 | 12.633 | 13.381 | 13.479 | 14.196 | 8.638 | 11.959 |
| CH848.0794.5.27 | | | | | | | | | | | | | |
| CH848.0808.15.15 | 0.09 | 2.1 | 0 | 0 | 0.654 | 5.213 | 12.677 | 13.02 | 12.679 | 14.232 | 13.779 | 10.426 | 12.47 |
| CH848.0808.15.25 | 0 | 2.649 | 0 | 0 | 0 | 0.111 | 12.638 | 14.614 | 14.431 | 16.074 | 13.547 | 10.781 | 13.808 |
| CH848.0808.15.27 | 0 | 2.458 | 0 | 0 | 0.547 | 7.204 | 12.946 | 13.3 | 14.344 | 14.169 | 14.392 | 10.051 | 13.358 |
| CH848.0808.15.43 | 0 | 0.257 | 0 | 0 | 0 | 1.105 | 11.031 | 12.017 | 12.494 | 13.123 | 13.729 | 9.533 | 11.154 |
| CH848.0836.10.31 | 0 | 1.235 | 0 | 0 | 4.946 | 9.379 | 13.228 | 13.514 | 13.184 | 14.549 | 14.15 | 11.41 | 13.392 |
| CH848.0836.10.36 | 0.09 | 3.091 | 0 | 0 | 1.432 | 6.854 | 13.276 | 14.168 | 14.372 | 15.399 | 13.851 | 13.124 | 13.883 |
| CH848.0864.3.03 | 0.098 | 0.282 | 0 | 0 | 0 | 0.189 | 4.557 | 9.487 | 9.813 | 9.5 | 10.511 | 1.5 | 10.28 |
| CH848.0864.7.26 | 0 | 2.228 | 0 | 0 | 3.317 | 7.974 | 12.992 | 13.409 | 14.054 | 14.623 | 14.708 | 11.567 | 14.406 |
| CH848.0864.7.39 | 0 | 1.241 | 0 | 0 | 2.189 | 4.419 | 11.379 | 12.728 | 14.285 | 14.589 | 14.66 | 11.695 | 13.891 |
| CH848.0893.10.05 | 0 | 0.2 | 0 | 0 | 0 | 0 | 1.594 | 5.893 | 5.178 | 5.714 | 5.617 | 0 | 4.266 |
| CH848.0893.10.06 | 0.102 | 5.427 | 0 | 0 | 0.248 | 1.512 | 9.393 | 10.986 | 12.682 | 13.148 | 13.798 | 7.228 | 11.735 |

Figure 35 continued

| | | | | | | | | | | | | | |
|---|---|---|---|---|---|---|---|---|---|---|---|---|---|
| CH848.0949.10.10 | 0 | 0 | 0 | 0 | 0 | 0 | 1.314 | 5.748 | 5.389 | 5.786 | 6.083 | 0 | 5.059 |
| **CH848.0949.10.17** | 0 | 2.488 | 0 | 2.484 | 6.311 | 9.4 | 12.9 | 13.606 | 14.346 | 14.625 | 14.288 | 13.249 | 13.388 |
| CH848.0949.10.18 | 0 | 0.324 | 0 | 0 | 0.348 | 2.878 | 8.422 | 10.427 | 9.743 | 9.744 | 10.895 | 0 | 10.148 |
| CH848.1120.10.05 | 0 | 0.504 | 0 | 0 | 1.363 | 5.495 | 11.793 | 11.85 | 11.826 | 13.163 | 13.76 | 8.953 | 11.488 |
| CH848.1120.10.13 | 0.13 | 3.176 | 0 | 0 | 0.105 | 0.23 | 5.139 | 8.753 | 8.114 | 7.651 | 8.858 | 0.749 | 8.252 |
| CH848.1120.10.21 | 0 | 12.046 | 0 | 0 | 0.228 | 3.731 | 12.083 | 12.74 | 13.236 | 14.466 | 14.187 | 13.549 | 13.768 |
| CH848.1120.10.24 | 0 | 2.771 | 0 | 0 | 1.736 | 6.607 | 12.153 | 12.773 | 12.447 | 13.506 | 14.072 | 8.065 | 12.372 |
| CH848.1120.10.32 | 0 | 9.799 | 0 | 0.069 | 5.258 | 10.07 | 13.333 | 13.6 | 13.265 | 14.723 | 14.048 | 14.122 | 13.709 |
| CH848.1120.10.41 | 0 | 4.948 | 0 | 0.064 | 3.535 | 7.483 | 12.536 | 13.741 | 13.337 | 14.853 | 14.413 | 13.657 | 13.757 |
| CH848.1305.10.13 | 0 | 4.237 | 0 | 0 | 0 | 0 | 0 | 0 | 0.511 | 2.701 | 2.345 | 0 | 5.796 |
| CH848.1305.10.21 | 0 | 12.053 | 0 | 0 | 0 | 0 | 0 | 0 | 0 | 0.712 | 0.154 | 0 | 3.81 |
| CH848.1305.10.30 | 0 | 1.824 | 0 | 0 | 0 | 0 | 0 | 0 | 0 | 0 | 0 | 0 | 0 |
| CH848.1305.10.35 | 0 | 3.481 | 0 | 0 | 0 | 0 | 0 | 0.216 | 0.785 | 3.823 | 2.97 | 0 | 5.851 |
| CH848.1432.5.06 | 0.095 | 7.656 | 0 | 0 | 0 | 3.823 | 12.103 | 12.345 | 12.45 | 13.448 | 13.713 | 8.785 | 10.971 |
| CH848.1432.5.18 | 0 | 2.199 | 0 | 0 | 0 | 0.646 | 11.791 | 11.372 | 12.292 | 13.482 | 13.94 | 13.656 | 13.976 |
| CH848.1432.5.27 | 0 | 0 | 0 | 0 | 0.09 | 0.857 | 7.03 | 11.724 | 11.653 | 12.192 | 12.901 | 1.451 | 11.783 |
| CH848.1432.5.35 | 0 | 7.242 | 0 | 0 | 0 | 0 | 0 | 0 | 0.139 | 0.968 | 0.5 | 0 | 3.984 |
| CH848.1432.5.41 | 0 | 2.086 | 0 | 0 | 0 | 0.779 | 11.712 | 12.73 | 12.747 | 14.55 | 14.034 | 13.606 | 13.765 |
| CH848.1432.5.48 | 0.088 | 7.064 | 0 | 0 | 0 | 4.146 | 12.239 | 12.558 | 12.491 | 13.398 | 13.94 | 8.748 | 11.149 |
| CH848.1432.5.50 | 0 | 3.015 | 0 | 0 | 0 | 0 | 0 | 0 | 0 | 0 | 0 | 0 | 0 |
| CH848.1432.5.56 | 0.097 | 0 | 0 | 0 | 0 | 0.136 | 11.264 | 10.958 | 12.193 | 13.148 | 13.275 | 13.771 | 14.489 |
| CH848.1621.4.12 | 0 | 1.662 | 0 | 0 | 0 | 0 | 0 | 0.266 | 9.087 | 8.975 | 11.808 | 8.1 | 9.969 |
| CH848.1621.4.15 | 0 | 6.84 | 0 | 0 | 0 | 0 | 8.482 | 10.843 | 12.735 | 12.677 | 13.791 | 8.777 | 9.827 |
| CH848.1621.4.25 | 0 | 9.443 | 0 | 0 | 0 | 0 | 0 | 0 | 0 | 0.155 | 0.208 | 0 | 3.892 |
| CH848.1621.4.31 | 0 | 2.926 | 0 | 0 | 0 | 0 | 8.349 | 9.536 | 11.146 | 13.454 | 13.703 | 12.463 | 13.673 |
| CH848.1621.4.44 | 0 | 1.807 | 0 | 0 | 0 | 0.743 | 11.496 | 11.232 | 12.098 | 13.421 | 13.719 | 13.445 | 13.937 |
| CH848.1621.4.46 | 0 | 2.668 | 0 | 0 | 0 | 0 | 0 | 0 | 0 | 0 | 0 | 0 | 0 |
| CH848.1635.10.55 | 0 | 2.037 | 0 | 0 | 0 | 0.342 | 11.14 | 11 | 11.906 | 13.121 | 13.856 | 13.16 | 14.183 |
| CH848.1651.07.34 | 0 | 3.553 | 0 | 0 | 0 | 0 | 8.411 | 9.728 | 11.197 | 13.524 | 13.265 | 12.666 | 13.799 |
| CH848.1651.10.04 | 0 | 2.992 | 0 | 0 | 0 | 0 | 10.247 | 10.855 | 11.592 | 13.976 | 14.076 | 12.703 | 13.762 |
| CH848.1651.10.07 | 0 | 11.175 | 0 | 0 | 0 | 0 | 0.394 | 0.642 | 1.258 | 0.769 | 2.096 | 0 | 0 |
| CH848.1651.7.50 | 0.181 | 10.336 | 0 | 0 | 0 | 0 | 0 | 0 | 0 | 0 | 0.147 | 0 | 0 |
| CH848.1677.05.21 | 0 | 2.166 | 0 | 0 | 0 | 0 | 9.551 | 10.067 | 11.335 | 13.701 | 13.604 | 12.835 | 13.622 |
| CH848.1720.05.01 | 0 | 10.784 | 0 | 0 | 0 | 0.559 | 12.018 | 13.701 | 13.794 | 14.808 | 13.345 | 9.382 | 10.695 |

Figure 35 continued

| | Autologous Neutralization Data IC50 | | | | | | | | | | | | |
|---|---|---|---|---|---|---|---|---|---|---|---|---|---|
| | | | | | | | wk 205 | | wk 232 | wk 234 | wk 205 | | |
| Subject.day.clone | DH272 | DH475 | DH270.UCA | DH270.IA4 | DH270.IA3 | DH270.IA2 | DH270.1 | DH270.IA1 | DH270.5 | DH270.4 | DH270.3 | PNG N332 | V1 loop length |
| CH848.0000.TF | 0.06 | >50 | >50 | >50 | >50 | >50 | >50 | >50 | >50 | 30.20 | >50 | N332 | 34 |
| CH848.0078.30.02 | <0.02 | >50 | >50 | >50 | >50 | >50 | >50 | 10.65 | 26.23 | 5.02 | >50 | N332 | 34 |
| CH848.0078.30.42 | 0.17 | >50 | >50 | >50 | >50 | >50 | >50 | 46.11 | >50 | 36.33 | >50 | N332 | 34 |
| CH848.0107.30.12 | 0.04 | >50 | >50 | >50 | >50 | >50 | >50 | 37.51 | >50 | 22.24 | >50 | N332 | 34 |
| CH848.0107.30.27 | 0.12 | >50 | >50 | >50 | >50 | >50 | >50 | 45.38 | >50 | 35.52 | >50 | N332 | 34 |
| CH848.0107.30.31 | 0.07 | >50 | >50 | >50 | >50 | >50 | >50 | 44.23 | >50 | 17.20 | >50 | N332 | 34 |
| CH848.0135.27.03 | <0.02 | >50 | >50 | >50 | >50 | >50 | >50 | 27.74 | 24.41 | 5.54 | >50 | N332 | 34 |
| CH848.0135.27.06 | 0.12 | 23.37 | >50 | >50 | >50 | >50 | >50 | >50 | >50 | 32.66 | >50 | N332 | 34 |
| CH848.0135.60.05 | 0.05 | 23.24 | >50 | >50 | >50 | >50 | >50 | 43.47 | >50 | 25.61 | >50 | N332 | 34 |
| CH848.0135.60.14 | 0.14 | 37.44 | >50 | >50 | >50 | >50 | >50 | 32.25 | >50 | 22.99 | >50 | N332 | 34 |
| CH848.0135.60.19 | 0.13 | 26.14 | >50 | >50 | >50 | >50 | >50 | >50 | >50 | 33.67 | >50 | N332 | 34 |
| CH848.0135.60.20 | 0.14 | 30.00 | >50 | >50 | >50 | >50 | >50 | 47.59 | >50 | 28.90 | >50 | N332 | 34 |
| CH848.0135.60.32 | 0.17 | 4.04 | >50 | >50 | >50 | >50 | >50 | >50 | >50 | 26.55 | >50 | N332 | 34 |
| CH848.0135.60.34 | <0.02 | 0.03 | >50 | >50 | >50 | >50 | >50 | 44.77 | >50 | 31.45 | >50 | N332 | 34 |
| CH848.0194.25.17 | 0.11 | 0.05 | >50 | >50 | >50 | >50 | >50 | 20.02 | 24.54 | 10.56 | >50 | N332 | 34 |
| CH848.0194.25.21 | | | | | | | | | | | | N332 | 34 |
| CH848.0194.25.24 | 0.10 | 7.36 | >50 | >50 | >50 | >50 | >50 | >50 | >50 | 34.60 | >50 | N332 | 34 |
| CH848.0194.25.48 | 0.07 | >50 | >50 | >50 | >50 | >50 | >50 | 3.60 | >50 | 18.67 | >50 | N332 | 34 |
| CH848.0274.30.02 | 0.55 | 3.14 | >50 | >50 | >50 | >50 | >50 | >50 | >50 | 31.05 | >50 | N332 | 34 |
| CH848.0274.30.07 | <0.02 | 1.97 | >50 | >50 | >50 | >50 | >50 | 4.10 | 16.96 | 4.59 | >50 | N332 | 34 |
| CH848.0274.30.09 | 0.23 | >50 | >50 | >50 | >50 | >50 | >50 | 23.21 | 30.14 | 27.46 | >50 | N332 | 34 |
| CH848.0274.30.14 | | | | | | | | | | | | N332 | 34 |
| CH848.0358.80.03 | 26.07 | >50 | >50 | >50 | >50 | >50 | 2.82 | 0.19 | 0.56 | 0.21 | 3.53 | N332 | 24 |
| CH848.0358.80.06 | 4.62 | 27.17 | >50 | >50 | >50 | >50 | 1.27 | 0.02 | <0.02 | <0.02 | 0.09 | N332 | 24 |
| CH848.0358.80.17 | 29.66 | >50 | >50 | >50 | >50 | >50 | 1.25 | 0.15 | 0.18 | 0.01 | 0.08 | N332 | 24 |
| CH848.0358.80.44 | 5.82 | >50 | >50 | >50 | >50 | >50 | 1.69 | 0.03 | 0.11 | 0.04 | 0.26 | N332 | 24 |
| CH848.0445.25.04 | >50 | 4.06 | >50 | >50 | >50 | >50 | 0.53 | 0.04 | 0.05 | 0.05 | <0.02 | N332 | 23 |
| CH848.0445.25.18 | >50 | >50 | >50 | >50 | >50 | >50 | 0.96 | 0.12 | 0.18 | 0.09 | 0.03 | N332 | 23 |
| CH848.0445.25.26 | | | | | | | | | | | | N332 | 23 |
| CH848.0445.30.41 | >50 | >50 | >50 | >50 | >50 | >50 | 0.87 | 0.06 | 0.03 | <0.02 | <0.02 | N332 | 23 |
| CH848.0445.30.42 | >50 | >50 | >50 | >50 | >50 | >50 | 3.12 | 0.12 | 0.30 | 0.11 | 0.15 | N332 | 23 |

Figure 35 continued

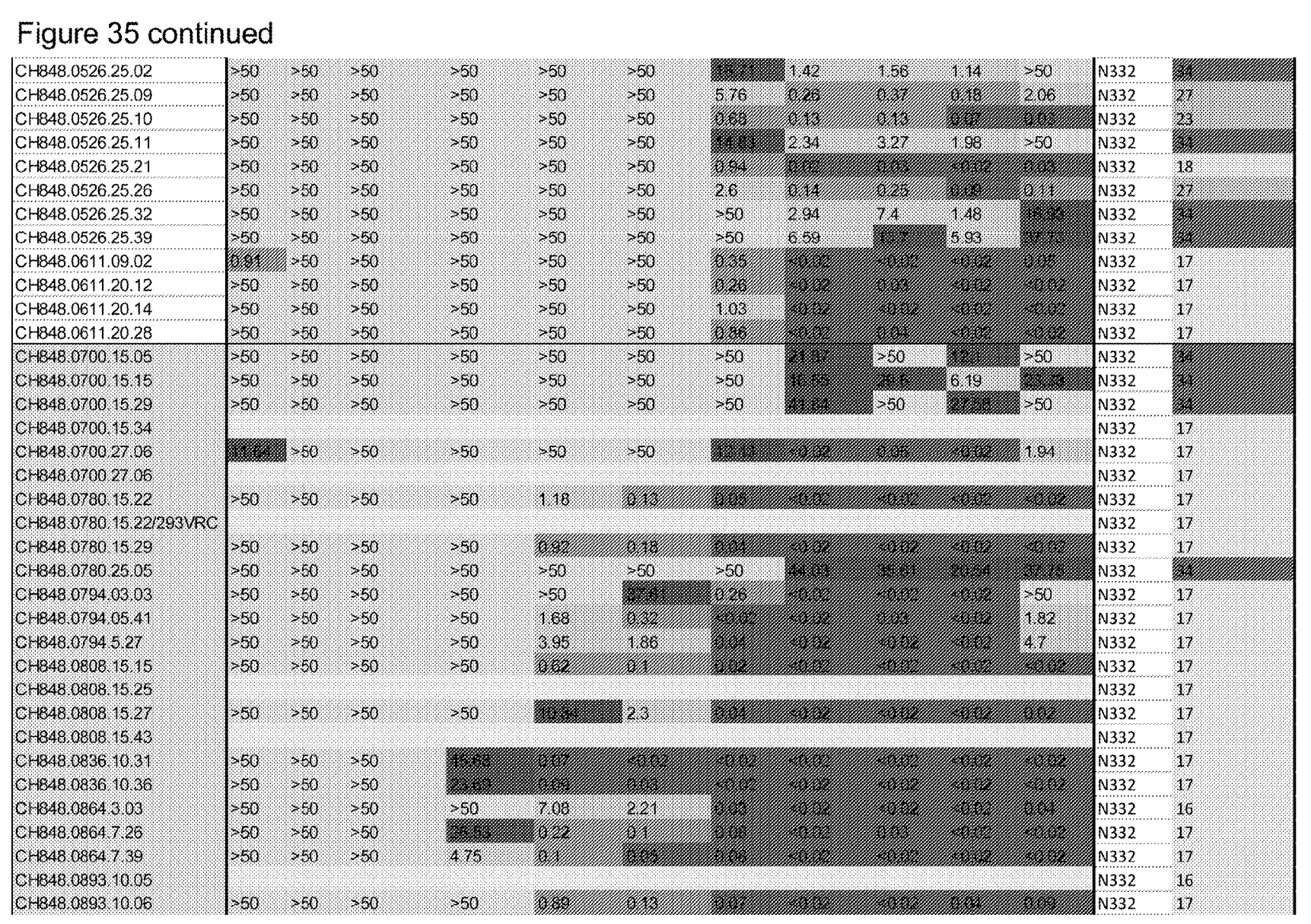

| | | | | | | | | | | | | | |
|---|---|---|---|---|---|---|---|---|---|---|---|---|---|
| CH848.0526.25.02 | >50 | >50 | >50 | >50 | >50 | >50 | 16.71 | 1.42 | 1.56 | 1.14 | >50 | N332 | 34 |
| CH848.0526.25.09 | >50 | >50 | >50 | >50 | >50 | >50 | 5.76 | 0.26 | 0.37 | 0.18 | 2.06 | N332 | 27 |
| CH848.0526.25.10 | >50 | >50 | >50 | >50 | >50 | >50 | 0.68 | 0.13 | 0.13 | 0.07 | 0.03 | N332 | 23 |
| CH848.0526.25.11 | >50 | >50 | >50 | >50 | >50 | >50 | 14.83 | 2.34 | 3.27 | 1.98 | >50 | N332 | 34 |
| CH848.0526.25.21 | >50 | >50 | >50 | >50 | >50 | >50 | 0.94 | 0.02 | 0.03 | <0.02 | 0.03 | N332 | 18 |
| CH848.0526.25.26 | >50 | >50 | >50 | >50 | >50 | >50 | 2.6 | 0.14 | 0.25 | 0.09 | 0.11 | N332 | 27 |
| CH848.0526.25.32 | >50 | >50 | >50 | >50 | >50 | >50 | >50 | 2.94 | 7.4 | 1.48 | 16.32 | N332 | 34 |
| CH848.0526.25.39 | >50 | >50 | >50 | >50 | >50 | >50 | >50 | 6.59 | 12.7 | 5.93 | 27.73 | N332 | 34 |
| CH848.0611.09.02 | 0.91 | >50 | >50 | >50 | >50 | >50 | 0.35 | <0.02 | <0.02 | <0.02 | 0.05 | N332 | 17 |
| CH848.0611.20.12 | >50 | >50 | >50 | >50 | >50 | >50 | 0.26 | <0.02 | 0.03 | <0.02 | <0.02 | N332 | 17 |
| CH848.0611.20.14 | >50 | >50 | >50 | >50 | >50 | >50 | 1.03 | <0.02 | <0.02 | <0.02 | <0.02 | N332 | 17 |
| CH848.0611.20.28 | >50 | >50 | >50 | >50 | >50 | >50 | 0.86 | <0.02 | 0.04 | <0.02 | <0.02 | N332 | 17 |
| CH848.0700.15.05 | >50 | >50 | >50 | >50 | >50 | >50 | >50 | 21.57 | >50 | 12.1 | >50 | N332 | 34 |
| CH848.0700.15.15 | >50 | >50 | >50 | >50 | >50 | >50 | >50 | 16.55 | 26.6 | 6.19 | 23.39 | N332 | 34 |
| CH848.0700.15.29 | >50 | >50 | >50 | >50 | >50 | >50 | >50 | 41.84 | >50 | 27.58 | >50 | N332 | 34 |
| CH848.0700.15.34 | | | | | | | | | | | | N332 | 17 |
| CH848.0700.27.06 | 11.64 | >50 | >50 | >50 | >50 | >50 | 12.13 | <0.02 | 0.05 | <0.02 | 1.94 | N332 | 17 |
| CH848.0700.27.06 | | | | | | | | | | | | N332 | 17 |
| CH848.0780.15.22 | >50 | >50 | >50 | >50 | 1.18 | 0.13 | 0.05 | <0.02 | <0.02 | <0.02 | <0.02 | N332 | 17 |
| CH848.0780.15.22/293VRC | | | | | | | | | | | | N332 | 17 |
| CH848.0780.15.29 | >50 | >50 | >50 | >50 | 0.92 | 0.18 | 0.04 | <0.02 | <0.02 | <0.02 | <0.02 | N332 | 17 |
| CH848.0780.25.05 | >50 | >50 | >50 | >50 | >50 | >50 | >50 | 44.03 | 35.81 | 20.54 | 37.75 | N332 | 34 |
| CH848.0794.03.03 | >50 | >50 | >50 | >50 | >50 | 27.81 | 0.26 | <0.02 | <0.02 | <0.02 | >50 | N332 | 17 |
| CH848.0794.05.41 | >50 | >50 | >50 | >50 | 1.68 | 0.32 | <0.02 | <0.02 | 0.03 | <0.02 | 1.82 | N332 | 17 |
| CH848.0794.5.27 | >50 | >50 | >50 | >50 | 3.95 | 1.86 | 0.04 | <0.02 | <0.02 | <0.02 | 4.7 | N332 | 17 |
| CH848.0808.15.15 | >50 | >50 | >50 | >50 | 0.62 | 0.1 | 0.02 | <0.02 | <0.02 | <0.02 | <0.02 | N332 | 17 |
| CH848.0808.15.25 | | | | | | | | | | | | N332 | 17 |
| CH848.0808.15.27 | >50 | >50 | >50 | >50 | 10.84 | 2.3 | 0.04 | <0.02 | <0.02 | <0.02 | 0.02 | N332 | 17 |
| CH848.0808.15.43 | | | | | | | | | | | | N332 | 17 |
| CH848.0836.10.31 | >50 | >50 | >50 | 15.68 | 0.07 | <0.02 | <0.02 | <0.02 | <0.02 | <0.02 | <0.02 | N332 | 17 |
| CH848.0836.10.36 | >50 | >50 | >50 | 23.69 | 0.09 | 0.03 | <0.02 | <0.02 | <0.02 | <0.02 | <0.02 | N332 | 17 |
| CH848.0864.3.03 | >50 | >50 | >50 | >50 | 7.08 | 2.21 | 0.03 | <0.02 | <0.02 | <0.02 | 0.04 | N332 | 16 |
| CH848.0864.7.26 | >50 | >50 | >50 | 28.53 | 0.22 | 0.1 | 0.08 | <0.02 | 0.03 | <0.02 | <0.02 | N332 | 17 |
| CH848.0864.7.39 | >50 | >50 | >50 | 4.75 | 0.1 | 0.05 | 0.06 | <0.02 | <0.02 | <0.02 | <0.02 | N332 | 17 |
| CH848.0893.10.05 | | | | | | | | | | | | N332 | 16 |
| CH848.0893.10.06 | >50 | >50 | >50 | >50 | 0.89 | 0.13 | 0.07 | <0.02 | <0.02 | 0.04 | 0.09 | N332 | 17 |

Figure 35 continued

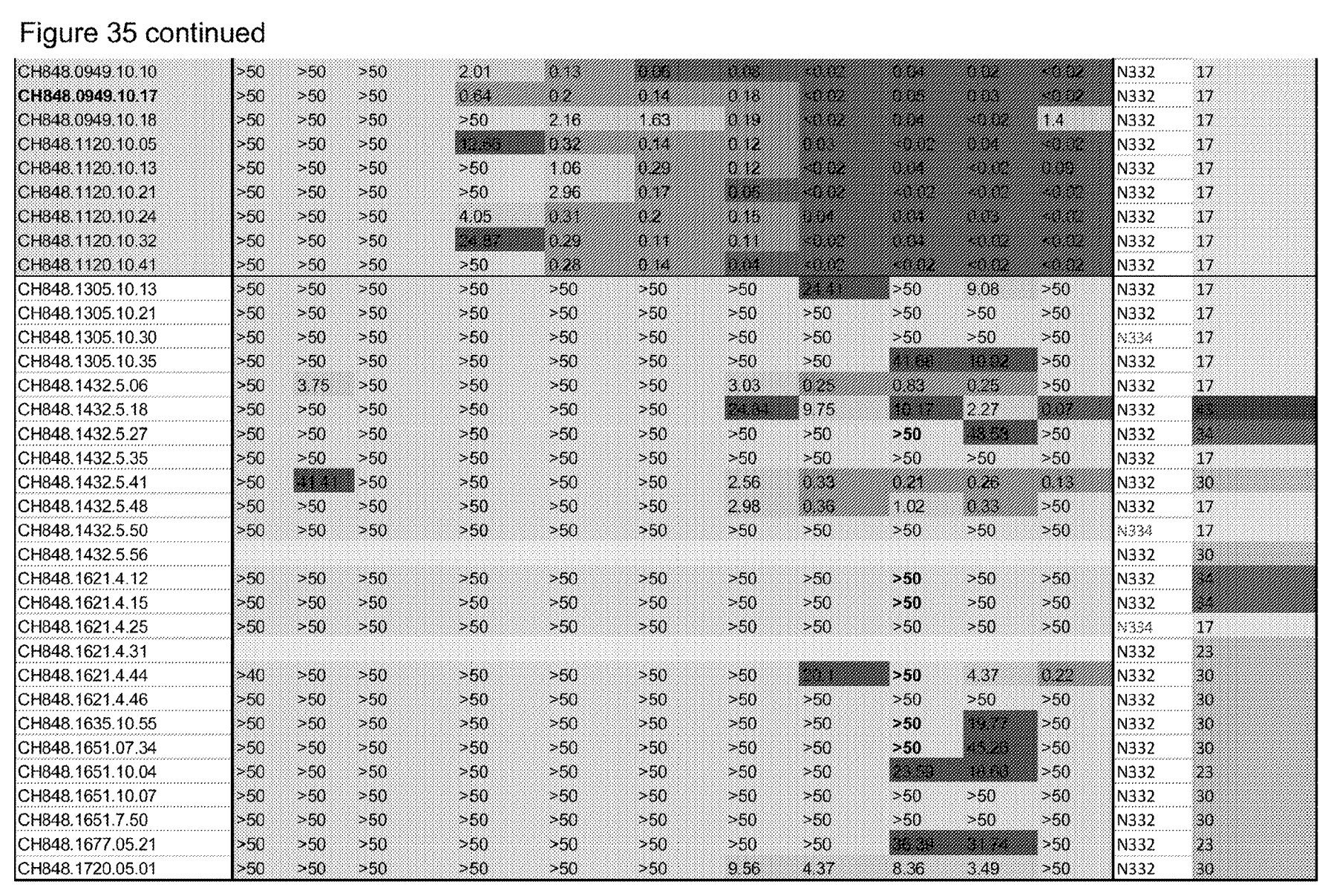

| | | | | | | | | | | | | | |
|---|---|---|---|---|---|---|---|---|---|---|---|---|---|
| CH848.0949.10.10 | >50 | >50 | >50 | 2.01 | 0.13 | 0.06 | 0.08 | <0.02 | 0.04 | 0.02 | <0.02 | N332 | 17 |
| **CH848.0949.10.17** | >50 | >50 | >50 | 0.64 | 0.2 | 0.14 | 0.18 | <0.02 | 0.05 | 0.03 | <0.02 | N332 | 17 |
| CH848.0949.10.18 | >50 | >50 | >50 | >50 | 2.16 | 1.63 | 0.19 | <0.02 | 0.04 | <0.02 | 1.4 | N332 | 17 |
| CH848.1120.10.05 | >50 | >50 | >50 | 12.65 | 0.32 | 0.14 | 0.12 | 0.03 | <0.02 | 0.04 | <0.02 | N332 | 17 |
| CH848.1120.10.13 | >50 | >50 | >50 | >50 | 1.06 | 0.29 | 0.12 | <0.02 | 0.04 | <0.02 | 0.09 | N332 | 17 |
| CH848.1120.10.21 | >50 | >50 | >50 | >50 | 2.96 | 0.17 | 0.05 | <0.02 | <0.02 | <0.02 | <0.02 | N332 | 17 |
| CH848.1120.10.24 | >50 | >50 | >50 | 4.05 | 0.31 | 0.2 | 0.15 | 0.04 | 0.04 | 0.03 | <0.02 | N332 | 17 |
| CH848.1120.10.32 | >50 | >50 | >50 | 24.87 | 0.29 | 0.11 | 0.11 | <0.02 | 0.04 | <0.02 | <0.02 | N332 | 17 |
| CH848.1120.10.41 | >50 | >50 | >50 | >50 | 0.28 | 0.14 | 0.04 | <0.02 | <0.02 | <0.02 | <0.02 | N332 | 17 |
| CH848.1305.10.13 | >50 | >50 | >50 | >50 | >50 | >50 | >50 | 24.41 | >50 | 9.08 | >50 | N332 | 17 |
| CH848.1305.10.21 | >50 | >50 | >50 | >50 | >50 | >50 | >50 | >50 | >50 | >50 | >50 | N332 | 17 |
| CH848.1305.10.30 | >50 | >50 | >50 | >50 | >50 | >50 | >50 | >50 | >50 | >50 | >50 | N334 | 17 |
| CH848.1305.10.35 | >50 | >50 | >50 | >50 | >50 | >50 | >50 | >50 | 41.68 | 10.92 | >50 | N332 | 17 |
| CH848.1432.5.06 | >50 | 3.75 | >50 | >50 | >50 | >50 | 3.03 | 0.25 | 0.83 | 0.25 | >50 | N332 | 17 |
| CH848.1432.5.18 | >50 | >50 | >50 | >50 | >50 | >50 | 24.84 | 9.75 | 10.17 | 2.27 | 0.07 | N332 | 43 |
| CH848.1432.5.27 | >50 | >50 | >50 | >50 | >50 | >50 | >50 | >50 | **>50** | 48.59 | >50 | N332 | 34 |
| CH848.1432.5.35 | >50 | >50 | >50 | >50 | >50 | >50 | >50 | >50 | >50 | >50 | >50 | N332 | 17 |
| CH848.1432.5.41 | >50 | 41.41 | >50 | >50 | >50 | >50 | 2.56 | 0.33 | 0.21 | 0.26 | 0.13 | N332 | 30 |
| CH848.1432.5.48 | >50 | >50 | >50 | >50 | >50 | >50 | 2.98 | 0.36 | 1.02 | 0.33 | >50 | N332 | 17 |
| CH848.1432.5.50 | >50 | >50 | >50 | >50 | >50 | >50 | >50 | >50 | >50 | >50 | >50 | N334 | 17 |
| CH848.1432.5.56 | | | | | | | | | | | | N332 | 30 |
| CH848.1621.4.12 | >50 | >50 | >50 | >50 | >50 | >50 | >50 | >50 | **>50** | >50 | >50 | N332 | 34 |
| CH848.1621.4.15 | >50 | >50 | >50 | >50 | >50 | >50 | >50 | >50 | **>50** | >50 | >50 | N332 | 34 |
| CH848.1621.4.25 | >50 | >50 | >50 | >50 | >50 | >50 | >50 | >50 | >50 | >50 | >50 | N334 | 17 |
| CH848.1621.4.31 | | | | | | | | | | | | N332 | 23 |
| CH848.1621.4.44 | >40 | >50 | >50 | >50 | >50 | >50 | >50 | 20.1 | **>50** | 4.37 | 0.22 | N332 | 30 |
| CH848.1621.4.46 | >50 | >50 | >50 | >50 | >50 | >50 | >50 | >50 | >50 | >50 | >50 | N332 | 30 |
| CH848.1635.10.55 | >50 | >50 | >50 | >50 | >50 | >50 | >50 | >50 | **>50** | 19.77 | >50 | N332 | 30 |
| CH848.1651.07.34 | >50 | >50 | >50 | >50 | >50 | >50 | >50 | >50 | **>50** | 45.26 | >50 | N332 | 30 |
| CH848.1651.10.04 | >50 | >50 | >50 | >50 | >50 | >50 | >50 | >50 | 23.59 | 18.60 | >50 | N332 | 23 |
| CH848.1651.10.07 | >50 | >50 | >50 | >50 | >50 | >50 | >50 | >50 | >50 | >50 | >50 | N332 | 30 |
| CH848.1651.7.50 | >50 | >50 | >50 | >50 | >50 | >50 | >50 | >50 | >50 | >50 | >50 | N332 | 30 |
| CH848.1677.05.21 | >50 | >50 | >50 | >50 | >50 | >50 | >50 | >50 | 36.39 | 31.74 | >50 | N332 | 23 |
| CH848.1720.05.01 | >50 | >50 | >50 | >50 | >50 | >50 | 9.56 | 4.37 | 8.36 | 3.49 | >50 | N332 | 30 |

Figure 36

The 9 autologous signature patterns shown are each very highly significantly associated with patterns of autologous antibody resistance or sensitivity.

All amino acids at all sites, as well as glycosylation sites, were evaluated, and the q-value reflects the full set of thousands of comparisons.
To be included in this table of the most statisically interesting signature sites, a site had to have a two pieces of supporting evidence:
a phylogenetically corrected q-value of <0.05 (Table T3 and T2), as well as a very strong simple Fisher p value of < 0.001 (T1)
or be within 8.5 angstroms of the bound PGT128 antibody, as well as a very strong simple Fisher p value of < 0.001 (T1)
Once a site meets the above criteria to be deemed of interest, other patterns with q < 0.2 are included in the summary, to get a more comprehensive view of the impact of the mutation on the V3 glycan lineages in this study.
If the senstivity/resistance profile is the opposite (the reds and blues are inverted) it suggests potential cooperativity for the DH2727/DH475 and DH270 lineage

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **oddsRatio** | **Distance** |
| Site 87: Cooperative pattern suggested by signatures: DH272 drives escape from E->K, DH475 from E->G, G and K are susceptible for 270. | | | | | | | | | | | | |
| AutNeut | T1 | 87 | E | DH270.IA4 | 0.027 | 9 | 0 | 51 | 30 | 0.055 | Inf | |
| AutNeut | T1 | 87 | E | DH270.IA3 | 9.80E-05 | 21 | 0 | 39 | 30 | 0.00048 | Inf | |
| AutNeut | T1 | 87 | E | DH270.IA2 | 4.20E-05 | 22 | 0 | 38 | 30 | 0.00022 | Inf | |
| AutNeut | T1 | 87 | E | DH270.1 | 0.00028 | 39 | 7 | 21 | 23 | 0.0012 | 6 | |
| AutNeut | T1 | 87 | E | DH270.5 | 0.0048 | 45 | 13 | 15 | 17 | 0.013 | 3.9 | |
| AutNeut | T1 | 87 | E | DH270.2 | 7.30E-05 | 45 | 9 | 15 | 21 | 0.00035 | 6.8 | |
| AutNeut | T1 | 87 | E | DH270.3 | 0.004 | 37 | 8 | 18 | 17 | 0.011 | 4.3 | |
| AutNeut | T3 | 87 | E | DH270.IA3 | 0.0002 | 8 | 0 | 11 | 29 | 0.0064 | Inf | |
| AutNeut | T3 | 87 | E | DH270.IA2 | 0.0002 | 8 | 0 | 11 | 29 | 0.0064 | Inf | |

Figure 36 continued

| Test data | see examples | position | Amino acid associated with: sensitivity resistance | | | r = row, c = column, for contingency tables | | | | | | Distance if in the contact region | |
|---|---|---|---|---|---|---|---|---|---|---|---|---|---|
| Run | Table | HXB2aa Env | test | Antibody | p-value | r1c1 | r1c2 | r2c1 | r2c2 | qvalue | oddsRatio | Distance | |
| Site 87: Cooperative pattern suggested by signatures: DH272 drives escape from E->K, DH475 from E->G, G and K are susceptible for 270. | | | | | | | | | | | | | |
| AutNeut | T3 | 87 | E | DH270.1 | 7.60E-05 | 16 | 7 | 3 | 22 | 0.0064 | 16 | | |
| AutNeut | T3 | 87 | E | DH270.5 | 0.00048 | 18 | 13 | 1 | 16 | 0.0081 | 21 | | |
| AutNeut | T3 | 87 | E | DH270.2 | 0.00039 | 16 | 9 | 3 | 20 | 0.0095 | 11 | | |
| AutNeut | T3 | 87 | E | DH270.3 | 0.00043 | 17 | 8 | 2 | 16 | 0.0088 | 16 | | |
| AutNeut | T1 | 87 | D | DH270.4 | 0.018 | 73 | 7 | 6 | 4 | 0.04 | 6.7 | | |
| AutNeut | T1 | 87 | G | DH270.IA4 | 0.039 | 5 | 4 | 70 | 11 | 0.075 | 0.2 | | |
| AutNeut | T1 | 87 | G | DH270.IA3 | 0.00086 | 12 | 9 | 63 | 6 | 0.0032 | 0.13 | | |
| AutNeut | T1 | 87 | G | DH270.IA2 | 0.0013 | 13 | 9 | 62 | 6 | 0.0043 | 0.14 | | |
| AutNeut | T1 | 87 | G | DH270.IA1 | 0.018 | 52 | 15 | 22 | 0 | 0.039 | 0 | | |
| AutNeut | T1 | 87 | G | DH270.1 | 0.0036 | 33 | 13 | 42 | 2 | 0.011 | 0.12 | | |
| AutNeut | T1 | 87 | G | DH270.5 | 0.075 | 45 | 13 | 30 | 2 | 0.13 | 0.23 | | |
| AutNeut | T1 | 87 | G | DH270.2 | 0.023 | 41 | 13 | 34 | 2 | 0.047 | 0.19 | | |
| AutNeut | T1 | 87 | G | DH270.3 | 0.0095 | 32 | 13 | 33 | 2 | 0.023 | 0.15 | | |
| AutNeut | T1 | 87 | K | DH270.2 | 0.015 | 28 | 26 | 28 | 8 | 0.036 | 0.31 | | |
| AutNeut | T1 | 87 | K | DH270.5 | 0.073 | 32 | 26 | 24 | 8 | 0.13 | 0.41 | | |
| AutNeut | T1 | 87 | E | DH272 | 5.50E-08 | 6 | 20 | 54 | 10 | 5.10E-07 | 0.058 | | |
| AutNeut | T3 | 87 | E | DH272 | 0.001 | 3 | 19 | 16 | 10 | 0.019 | 0.1 | | |
| AutNeut | T1 | 87 | D | DH272 | 0.03 | 26 | 0 | 53 | 11 | 0.06 | Inf | | |
| AutNeut | T1 | 87 | K | DH272 | 0.0076 | 22 | 4 | 34 | 30 | 0.019 | 4.8 | | |
| AutNeut | T1 | 87 | E | DH475 | 0.00036 | 4 | 11 | 56 | 17 | 0.0014 | 0.11 | | |

Figure 36 continued

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **oddsRatio** | **Distance** |
| Site 87: Cooperative pattern suggested by signatures: DH272 drives escape from E->K, DH475 from E->G, G and K are susceptible for 270. | | | | | | | | | | | | |
| AutNeut | T3 | 87 | E | DH475 | 0.016 | 1 | 10 | 18 | 17 | 0.17 | 0.099 | |
| AutNeut | T1 | 87 | G | DH475 | 0.064 | 15 | 0 | 58 | 15 | 0.12 | Inf | |
| | | | | | | | | | | | | |
| Site 185 cooperative pattern | | | | | | | | | | | | |
| AutNeut | T1 | 185 | D | DH270.IA3 | 0.12 | 17 | 4 | 41 | 28 | 0.2 | 2.9 | |
| AutNeut | T1 | 185 | D | DH270.IA2 | 0.072 | 18 | 4 | 40 | 28 | 0.12 | 3.1 | |
| AutNeut | T1 | 185 | D | DH270.1 | 5.40E-05 | 39 | 7 | 19 | 25 | 0.00028 | 7.2 | |
| AutNeut | T1 | 185 | D | DH270.5 | 0.0011 | 45 | 13 | 13 | 19 | 0.0037 | 5 | |
| AutNeut | T1 | 185 | D | DH270.2 | 9.70E-07 | 46 | 8 | 12 | 24 | 7.80E-06 | 11 | |
| AutNeut | T1 | 185 | D | DH270.3 | 0.00032 | 38 | 7 | 16 | 19 | 0.0013 | 6.3 | |
| AutNeut | T1 | 185 | N | DH270.1 | 0.0011 | 10 | 36 | 25 | 19 | 0.0037 | 0.22 | |
| AutNeut | T1 | 185 | N | DH270.2 | 1.80E-05 | 11 | 43 | 24 | 12 | 0.00011 | 0.13 | |
| AutNeut | T1 | 185 | N | DH270.3 | 0.0047 | 10 | 35 | 19 | 16 | 0.013 | 0.25 | |
| AutNeut | T1 | 185 | N | DH270.5 | 0.0062 | 16 | 42 | 19 | 13 | 0.016 | 0.26 | |
| AutNeut | T1 | 185 | S | DH270.IA2 | 0.058 | 20 | 2 | 68 | 0 | 0.1 | 0 | |
| AutNeut | T1 | 185 | S | DH270.IA3 | 0.052 | 19 | 2 | 69 | 0 | 0.097 | 0 | |
| AutNeut | T1 | 185 | D | DH272 | 2.10E-08 | 5 | 21 | 53 | 11 | 2.30E-07 | 0.052 | |
| AutNeut | T1 | 185 | N | DH272 | 1.80E-08 | 22 | 4 | 13 | 51 | 2.00E-07 | 21 | |
| AutNeut | T1 | 185 | D | DH475 | 6.50E-06 | 2 | 13 | 56 | 17 | 4.40E-05 | 0.049 | |

Figure 36 continued

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **oddsRatio** | **Distance** |
| Site 87: Cooperative pattern suggested by signatures: DH272 drives escape from E->K, DH475 from E->G, G and K are susceptible for 270. | | | | | | | | | | | | |
| AutNeut | T1 | 185 | N | DH475 | 2.80E-05 | 13 | 2 | 20 | 53 | 0.00015 | 17 | |
| | | | | | | | | | | | | |
| Site 300: cooperative pattern | | | | | | | | | | | | |
| AutNeut | T1 | 300 | G | DH270.IA4 | 0.00039 | 9 | 0 | 31 | 50 | 0.0015 | Inf | 6.35 |
| AutNeut | T1 | 300 | G | DH270.IA3 | 7.70E-10 | 21 | 0 | 19 | 50 | 1.30E-08 | Inf | 6.35 |
| AutNeut | T1 | 300 | G | DH270.IA2 | 2.10E-10 | 22 | 0 | 18 | 50 | 3.90E-09 | Inf | 6.35 |
| AutNeut | T1 | 300 | G | DH270.1 | 0.0016 | 28 | 18 | 12 | 32 | 0.005 | 4.1 | 6.35 |
| AutNeut | T1 | 300 | G | DH270.5 | 0.027 | 31 | 27 | 9 | 23 | 0.056 | 2.9 | 6.35 |
| AutNeut | T1 | 300 | G | DH270.2 | 0.0001 | 33 | 21 | 7 | 29 | 0.00049 | 6.4 | 6.35 |
| AutNeut | T1 | 300 | G | DH270.3 | 0.11 | 24 | 21 | 12 | 23 | 0.2 | 2.2 | 6.35 |
| AutNeut | T1 | 300 | Y | DH270.IA1 | 0.031 | 65 | 2 | 18 | 4 | 0.064 | 7 | 6.35 |
| AutNeut | T1 | 300 | Y | DH270.1 | 0.11 | 45 | 1 | 39 | 5 | 0.18 | 5.7 | 6.35 |
| AutNeut | T1 | 300 | N | DH270.IA4 | 5.50E-05 | 0 | 9 | 57 | 24 | 0.00028 | 0 | 6.35 |
| AutNeut | T1 | 300 | N | DH270.IA3 | 2.10E-12 | 0 | 21 | 57 | 12 | 4.60E-11 | 0 | 6.35 |
| AutNeut | T1 | 300 | N | DH270.IA2 | 3.60E-13 | 0 | 22 | 57 | 11 | 7.30E-12 | 0 | 6.35 |
| AutNeut | T1 | 300 | N | DH270.1 | 7.30E-05 | 20 | 26 | 37 | 7 | 0.00035 | 0.15 | 6.35 |
| AutNeut | T1 | 300 | N | DH270.2 | 0.0073 | 28 | 26 | 29 | 7 | 0.018 | 0.26 | 6.35 |
| AutNeut | T1 | 300 | N | DH270.5 | 0.012 | 31 | 27 | 26 | 6 | 0.028 | 0.27 | 6.35 |
| AutNeut | T1 | 300 | Y | DH270.2 | 0.077 | 48 | 6 | 36 | 0 | 0.13 | 0 | 6.35 |

Figure 36 continued

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **oddsRatio** | **Distance** |
| Site 300: cooperative pattern | | | | | | | | | | | | |
| AutNeut | T1 | 300 | G | DH272 | 6.90E-09 | 0 | 26 | 40 | 24 | 7.70E-08 | 0 | 6.35 |
| AutNeut | T1 | 300 | N | DH272 | 4.70E-07 | 26 | 0 | 31 | 33 | 4.00E-06 | Inf | 6.35 |
| AutNeut | T1 | 300 | G | DH475 | 0.0089 | 2 | 13 | 38 | 35 | 0.021 | 0.14 | 6.35 |
| AutNeut | T1 | 300 | N | DH475 | 0.042 | 13 | 2 | 42 | 31 | 0.078 | 4.7 | 6.35 |
| | | | | | | | | | | | | |
| site 325: mutual resistance for N, a late mutation | | | | | | | | | | | | |
| AutNeut | T1 | 325 | E | DH270.IA3 | 0.025 | 17 | 4 | 67 | 2 | 0.051 | 0.13 | 2.73 |
| AutNeut | T1 | 325 | E | DH270.IA2 | 0.003 | 17 | 5 | 67 | 1 | 0.0089 | 0.053 | 2.73 |
| AutNeut | T1 | 325 | E | DH270.1 | 0.026 | 40 | 6 | 44 | 0 | 0.055 | 0 | 2.73 |
| AutNeut | T1 | 325 | E | DH270.5 | 0.085 | 52 | 6 | 32 | 0 | 0.15 | 0 | 2.73 |
| AutNeut | T1 | 325 | E | DH270.2 | 0.077 | 48 | 6 | 36 | 0 | 0.13 | 0 | 2.73 |
| AutNeut | T1 | 325 | D | DH270.IA1 | 0.037 | 7 | 60 | 7 | 15 | 0.072 | 0.25 | 2.73 |
| AutNeut | T1 | 325 | D | DH270.IA1 | 0.037 | 7 | 60 | 7 | 15 | 0.072 | 0.25 | 2.73 |
| AutNeut | T3 | 325 | D | DH270.4 | 0.018 | 5 | 71 | 3 | 4 | 0.17 | 0.099 | 2.73 |
| AutNeut | T1 | 325 | D | DH270.4 | 0.00072 | 8 | 72 | 6 | 4 | 0.0028 | 0.078 | 2.73 |
| AutNeut | T1 | 325 | N | DH270.IA1 | 0.00017 | 66 | 1 | 15 | 7 | 0.00078 | 29 | 2.73 |
| AutNeut | T1 | 325 | N | DH270.1 | 0.0023 | 46 | 0 | 36 | 8 | 0.0066 | Inf | 2.73 |
| AutNeut | T1 | 325 | N | DH270.2 | 0.00039 | 54 | 0 | 28 | 8 | 0.0016 | Inf | 2.73 |
| AutNeut | T1 | 325 | N | DH270.3 | 0.00081 | 45 | 0 | 27 | 8 | 0.003 | Inf | 2.73 |

Figure 36 continued

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **odds Ratio** | **Distance** |
| site 325: mutual resistance for N, a late mutation | | | | | | | | | | | | |
| AutNeut | T1 | 325 | N | DH270.4 | 8.70E-06 | 78 | 2 | 4 | 6 | 5.40E-05 | 51 | 2.73 |
| AutNeut | T1 | 325 | N | DH270.5 | 0.0027 | 57 | 1 | 25 | 7 | 0.0079 | 15 | 2.73 |
| AutNeut | T2 | 325 | N | DH270.2 | 0.0064 | 0 | 54 | 5 | 28 | 0.19 | 0 | 2.73 |
| AutNeut | T2 | 325 | N | DH270.4 | 0.0031 | 2 | 78 | 3 | 4 | 0.18 | 0.038 | 2.73 |
| AutNeut | T1 | 325 | D | DH272 | 0.059 | 1 | 25 | 13 | 51 | 0.11 | 0.16 | 2.73 |
| AutNeut | T1 | 325 | N | DH272 | 0.099 | 26 | 0 | 56 | 8 | 0.16 | Inf | 2.73 |
| | | | | | | | | | | | | |
| Site 335: cooperative pattern: | | | | | | | | | | | | |
| AutNeut | T1 | 335 | K | DH270.IA4 | 0.059 | 6 | 3 | 74 | 7 | 0.11 | 0.19 | |
| AutNeut | T2 | 335 | K | DH270.IA4 | 0.0035 | 3 | 6 | 1 | 73 | 0.13 | 33 | |
| AutNeut | T2 | 335 | K | DH270.IA3 | 0.0033 | 4 | 17 | 0 | 62 | 0.15 | Inf | |
| AutNeut | T2 | 335 | K | DH270.IA2 | 0.004 | 4 | 18 | 0 | 61 | 0.12 | Inf | |
| AutNeut | T1 | 335 | E | DH270.IA4 | 0.059 | 3 | 6 | 7 | 74 | 0.11 | 5.1 | |
| AutNeut | T3 | 335 | E | DH270.IA4 | 0.0035 | 3 | 6 | 1 | 73 | 0.058 | 33 | |
| AutNeut | T3 | 335 | E | DH270.IA3 | 0.0033 | 4 | 17 | 0 | 62 | 0.058 | Inf | |
| AutNeut | T3 | 335 | E | DH270.IA2 | 0.004 | 4 | 18 | 0 | 61 | 0.059 | Inf | |
| AutNeut | T1 | 335 | E | DH272 | 0.057 | 0 | 26 | 10 | 54 | 0.1 | 0 | |
| AutNeut | T1 | 335 | K | DH272 | 0.057 | 26 | 0 | 54 | 10 | 0.1 | Inf | |

Figure 36 continued

| Test data | see examples | position | Amino acid associated with: sensitivity resistance | | | r = row, c = column, for contingency tables | | | | | | Distance if in the contact region | |
|---|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **odds Ratio** | **Distance** | |
| Site 344: cooperative pattern: | | | | | | | | | | | | | |
| AutNeut | T1 | 344 | E | DH270.IA4 | 0.01 | 9 | 0 | 45 | 36 | 0.024 | Inf | | |
| AutNeut | T1 | 344 | E | DH270.IA3 | 4.50E-06 | 21 | 0 | 33 | 36 | 2.80E-05 | Inf | | |
| AutNeut | T1 | 344 | E | DH270.IA2 | 1.90E-06 | 22 | 0 | 32 | 36 | 1.40E-05 | Inf | | |
| AutNeut | T3 | 344 | E | DH270.1 | 0.012 | 4 | 10 | 0 | 25 | 0.16 | Inf | | |
| AutNeut | T1 | 344 | E | DH270.1 | 0.0005 | 36 | 10 | 18 | 26 | 0.002 | 5.1 | | |
| AutNeut | T1 | 344 | E | DH270.3 | 0.096 | 34 | 11 | 20 | 15 | 0.16 | 2.3 | | |
| AutNeut | T1 | 344 | E | DH270.5 | 0.0072 | 41 | 17 | 13 | 19 | 0.018 | 3.5 | | |
| AutNeut | T1 | 344 | E | DH270.2 | 0.017 | 38 | 16 | 16 | 20 | 0.038 | 2.9 | | |
| AutNeut | T1 | 344 | E | DH270.4 | 0.046 | 45 | 35 | 9 | 1 | 0.084 | 0.15 | | |
| AutNeut | T1 | 344 | K | DH270.1 | 0.011 | 15 | 31 | 27 | 17 | 0.025 | 0.31 | | |
| AutNeut | T1 | 344 | K | DH270.IA2 | 1.00E-07 | 0 | 22 | 42 | 26 | 9.00E-07 | 0 | | |
| AutNeut | T1 | 344 | K | DH270.IA3 | 1.30E-07 | 0 | 21 | 42 | 27 | 1.30E-06 | 0 | | |
| AutNeut | T1 | 344 | K | DH270.4 | 0.098 | 40 | 40 | 2 | 8 | 0.16 | 3.9 | | |
| AutNeut | T1 | 344 | K | DH270.IA4 | 0.003 | 0 | 9 | 42 | 39 | 0.0089 | 0 | | |
| AutNeut | T1 | 344 | K | DH270.5 | 0.029 | 22 | 36 | 20 | 12 | 0.06 | 0.37 | | |
| AutNeut | T1 | 344 | K | DH270.2 | 0.086 | 21 | 33 | 21 | 15 | 0.15 | 0.46 | | |
| AutNeut | T1 | 344 | Q | DH270.1 | 0.056 | 41 | 5 | 44 | 0 | 0.1 | 0 | | |
| AutNeut | T1 | 344 | Q | DH270.2 | 0.081 | 49 | 5 | 36 | 0 | 0.14 | 0 | | |
| AutNeut | T1 | 344 | R | DH270.4 | 0.11 | 80 | 0 | 9 | 1 | 0.18 | Inf | | |

Figure 36 continued

| Test data | see examples | position | Amino acid associated with: sensitivity resistance | | | r = row, c = column, for contingency tables | | | | | | Distance if in the contact region | |
|---|---|---|---|---|---|---|---|---|---|---|---|---|---|
| Run | Table | HXB2aa Env | test | Antibody | p-value | r1c1 | r1c2 | r2c1 | r2c2 | qvalue | odds Ratio | Distance | |
| Site 344: cooperative pattern: | | | | | | | | | | | | | |
| AutNeut | T1 | 344 | E | DH272 | 2.00E-09 | 3 | 23 | 51 | 13 | 2.70E-08 | 0.035 | | |
| AutNeut | T1 | 344 | K | DH272 | 1.50E-08 | 24 | 2 | 18 | 46 | 1.60E-07 | 29 | | |
| AutNeut | T1 | 344 | E | DH475 | 4.40E-05 | 2 | 13 | 52 | 21 | 0.00023 | 0.064 | | |
| AutNeut | T1 | 344 | K | DH475 | 0.0005 | 13 | 2 | 27 | 46 | 0.0019 | 11 | | |
| | | | | | | | | | | | | | |
| Site 413: cooperative pattern: | | | | | | | | | | | | | |
| AutNeut | T1 | 413 | T | DH270.IA3 | 0.012 | 5 | 16 | 39 | 30 | 0.029 | 0.24 | | |
| AutNeut | T1 | 413 | T | DH270.IA2 | 0.0065 | 5 | 17 | 39 | 29 | 0.016 | 0.22 | | |
| AutNeut | T1 | 413 | T | DH270.IA1 | 4.60E-05 | 24 | 43 | 19 | 3 | 0.00024 | 0.091 | | |
| AutNeut | T1 | 413 | T | DH270.1 | 2.10E-07 | 10 | 36 | 34 | 10 | 1.90E-06 | 0.085 | | |
| AutNeut | T1 | 413 | T | DH270.2 | 1.10E-05 | 16 | 38 | 28 | 8 | 7.00E-05 | 0.12 | | |
| AutNeut | T1 | 413 | T | DH270.3 | 4.00E-07 | 8 | 37 | 26 | 9 | 3.30E-06 | 0.078 | | |
| AutNeut | T1 | 413 | T | DH270.5 | 6.50E-06 | 18 | 40 | 26 | 6 | 4.40E-05 | 0.11 | | |
| AutNeut | T1 | 413 | I | DH270.IA1 | 0.0032 | 66 | 1 | 17 | 5 | 0.0095 | 19 | | |
| AutNeut | T1 | 413 | I | DH270.1 | 0.011 | 46 | 0 | 38 | 6 | 0.027 | Inf | | |
| AutNeut | T1 | 413 | N | DH270.IA3 | 0.0041 | 19 | 2 | 39 | 30 | 0.011 | 7.2 | | |
| AutNeut | T1 | 413 | N | DH270.IA2 | 0.004 | 20 | 2 | 38 | 30 | 0.011 | 7.7 | | |
| AutNeut | T1 | 413 | N | DH270.IA1 | 0.0094 | 49 | 18 | 9 | 13 | 0.022 | 3.9 | | |
| AutNeut | T1 | 413 | N | DH270.1 | 5.90E-07 | 41 | 5 | 17 | 27 | 4.90E-06 | 13 | | |

Figure 36 continued

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **oddsRatio** | **Distance** |
| Site 413: cooperative pattern: | | | | | | | | | | | | |
| AutNeut | T1 | 413 | N | DH270.3 | 5.50E-10 | 43 | 2 | 11 | 24 | 8.70E-09 | 44 | |
| AutNeut | T1 | 413 | N | DH270.5 | 1.90E-06 | 48 | 10 | 10 | 22 | 1.40E-05 | 10 | |
| AutNeut | T1 | 413 | N | DH270.2 | 3.20E-09 | 48 | 6 | 10 | 26 | 3.60E-08 | 20 | |
| AutNeut | T1 | 413 | N | DH272 | 3.40E-07 | 6 | 20 | 52 | 12 | 2.60E-06 | 0.072 | |
| AutNeut | T1 | 413 | T | DH272 | 0.00015 | 21 | 5 | 23 | 41 | 0.00071 | 7.3 | |
| AutNeut | T1 | 413 | N | DH475 | 4.90E-09 | 0 | 15 | 58 | 15 | 5.40E-08 | 0 | |
| AutNeut | T1 | 413 | T | DH475 | 3.10E-06 | 15 | 0 | 27 | 46 | 2.00E-05 | Inf | |
| | | | | | | | | | | | | |
| Site 624: mutual resistnace, late escape from DH270 lineage, similar association with DH272 | | | | | | | | | | | | |
| AutNeut | T1 | 624 | D | DH270.IA3 | 0.0095 | 0 | 21 | 17 | 52 | 0.022 | 0 | |
| AutNeut | T1 | 624 | D | DH270.IA2 | 0.0095 | 0 | 22 | 17 | 51 | 0.023 | 0 | |
| AutNeut | T1 | 624 | D | DH270.IA1 | 5.20E-07 | 4 | 63 | 13 | 9 | 4.40E-06 | 0.047 | |
| AutNeut | T1 | 624 | D | DH270.1 | 0.0027 | 3 | 43 | 14 | 30 | 0.008 | 0.15 | |
| AutNeut | T1 | 624 | D | DH270.3 | 0.0017 | 2 | 43 | 11 | 24 | 0.0052 | 0.1 | |
| AutNeut | T1 | 624 | D | DH270.4 | 1.10E-05 | 9 | 71 | 8 | 2 | 6.90E-05 | 0.034 | |
| AutNeut | T1 | 624 | D | DH270.5 | 0.0015 | 5 | 53 | 12 | 20 | 0.0047 | 0.16 | |
| AutNeut | T3 | 624 | D | DH270.IA1 | 0.012 | 3 | 63 | 4 | 9 | 0.16 | 0.11 | |
| AutNeut | T3 | 624 | D | DH270.3 | 0.016 | 1 | 43 | 6 | 24 | 0.16 | 0.096 | |
| AutNeut | T3 | 624 | D | DH270.4 | 0.0039 | 4 | 71 | 3 | 2 | 0.064 | 0.042 | |

Figure 36 continued

| Test data | see examples | position | Amino acid associated with: sensitivity resistance | | | r = row, c = column, for contingency tables | | | | | | Distance if in the contact region |
|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **oddsRatio** | **Distance** |
| Site 624: mutual resistnace, late escape from DH270 lineage, similar association with DH272 | | | | | | | | | | | | |
| AutNeut | T1 | 624 | E | DH270.3 | 0.08 | 45 | 0 | 32 | 3 | 0.14 | Inf | |
| AutNeut | T1 | 624 | G | DH270.IA1 | 0.0025 | 65 | 2 | 16 | 6 | 0.0072 | 12 | |
| AutNeut | T1 | 624 | G | DH270.4 | 0.042 | 75 | 5 | 7 | 3 | 0.078 | 6.2 | |
| AutNeut | T1 | 624 | N | DH270.IA1 | 0.0032 | 66 | 1 | 17 | 5 | 0.0095 | 19 | |
| AutNeut | T1 | 624 | N | DH270.1 | 0.011 | 46 | 0 | 38 | 6 | 0.027 | Inf | |
| AutNeut | T1 | 624 | N | DH270.4 | 0.0011 | 78 | 2 | 6 | 4 | 0.0038 | 24 | |
| AutNeut | T1 | 624 | N | DH270.5 | 0.0015 | 58 | 0 | 26 | 6 | 0.0046 | Inf | |
| AutNeut | T1 | 624 | D | DH272 | 0.0022 | 0 | 26 | 17 | 47 | 0.0062 | 0 | |
| AutNeut | T1 | 624 | G | DH272 | 0.099 | 26 | 0 | 56 | 8 | 0.16 | Inf | |
| | | | | | | | | | | | | |
| Site 818: cooperative pattern: | | | | | | | | | | | | |
| AutNeut | T1 | 818 | L | DH270.1 | 0.089 | 16 | 30 | 24 | 20 | 0.15 | 0.45 | |
| AutNeut | T1 | 818 | L | DH270.IA2 | 0.001 | 3 | 19 | 37 | 31 | 0.0037 | 0.14 | |
| AutNeut | T1 | 818 | L | DH270.IA3 | 0.0021 | 3 | 18 | 37 | 32 | 0.0062 | 0.15 | |
| AutNeut | T1 | 818 | L | DH270.IA4 | 0.0039 | 0 | 9 | 40 | 41 | 0.011 | 0 | |
| AutNeut | T1 | 818 | L | DH270.2 | 0.051 | 19 | 35 | 21 | 15 | 0.092 | 0.39 | |
| AutNeut | T1 | 818 | L | DH270.4 | 0.0019 | 40 | 40 | 0 | 10 | 0.0058 | Inf | |
| AutNeut | T1 | 818 | L | DH270.IA1 | 0.087 | 33 | 34 | 6 | 16 | 0.15 | 2.6 | |
| AutNeut | T1 | 818 | I | DH270.4 | 0.0019 | 40 | 40 | 10 | 0 | 0.0058 | 0 | |

Figure 36 continued

| Test data | see examples | position | Amino acid associated with: sensitivity resistance | | | r = row, c = column, for contingency tables | | | | | | Distance if in the contact region | |
|---|---|---|---|---|---|---|---|---|---|---|---|---|---|
| **Run** | **Table** | **HXB2aa Env** | **test** | **Antibody** | **p-value** | **r1c1** | **r1c2** | **r2c1** | **r2c2** | **qvalue** | **odds Ratio** | **Distance** | |
| Site 818: cooperative pattern: | | | | | | | | | | | | | |
| AutNeut | T1 | 818 | I | DH270.IA1 | 0.087 | 34 | 33 | 16 | 6 | 0.15 | 0.39 | | |
| AutNeut | T1 | 818 | I | DH270.1 | 0.089 | 30 | 16 | 20 | 24 | 0.15 | 2.2 | | |
| AutNeut | T1 | 818 | I | DH270.IA2 | 0.001 | 19 | 3 | 31 | 37 | 0.0037 | 7.4 | | |
| AutNeut | T1 | 818 | I | DH270.IA3 | 0.0021 | 18 | 3 | 32 | 37 | 0.0062 | 6.8 | | |
| AutNeut | T1 | 818 | I | DH270.IA4 | 0.0039 | 9 | 0 | 41 | 40 | 0.011 | Inf | | |
| AutNeut | T1 | 818 | I | DH270.2 | 0.051 | 35 | 19 | 15 | 21 | 0.092 | 2.6 | | |
| AutNeut | T3 | 818 | I | DH272 | 0.01 | 0 | 24 | 5 | 13 | 0.17 | 0 | | |
| AutNeut | T1 | 818 | I | DH272 | 2.70E-09 | 2 | 24 | 48 | 16 | 3.10E-08 | 0.029 | | |
| AutNeut | T1 | 818 | L | DH272 | 2.70E-09 | 24 | 2 | 16 | 48 | 3.10E-08 | 34 | | |
| AutNeut | T1 | 818 | I | DH475 | 0.0003 | 2 | 13 | 48 | 25 | 0.0012 | 0.082 | | |
| AutNeut | T1 | 818 | L | DH475 | 0.0003 | 13 | 2 | 25 | 48 | 0.0012 | 12 | | |

Figure 36 continued

Examples of how to read contingency tables

How to read a phylogenetically corrected T3 contingency table:

| pos 87, T3 IA2 E | E -> !E | E -> E |
|---|---|---|
| DH473 pos | 8 | 0 |
| DH473 neg | 11 | 29 |

Fisher's exact p = 0.0002
In this case, T3 is tracking the evolution of an ancestral state of E, to not-E (!E), any other amino acid, at position 87.

If E is lost, changes to an amino acid that is not E, the phenotype tends to be associatied nd with IA2 activity.

Infinite and 0 are important cases of perfect associations, other values indicate relative levels of enrichment.

How to read a simple (not phylogenetically corrected) T1 contingency table:

| position 87 T1 IA3 G | !G | G |
|---|---|---|
| IA3 pos | 12 | 9 |
| IA3 neg | 63 | 6 |

Fisher's exact p = 0.00086
In this case, T1 is tracking the presence of G, and not not-G (!G), any other amino acid, at position 87, in all sequences tested.

Odds Ratio = 0.13: for T1, OR > 1 indicates an amino acid associated with resistance, <1 senstivity
Infinite and 0 are important cases of perfect associations, other values (like 0.13) indicate relative levels of enrichment.

How to read a phylogenetically corrected T2 contingency table:

| T2 DH473 N | !N->N | !N->!N |
|---|---|---|
| DH473 pos | 0 | 54 |
| DH473 neg | 5 | 28 |

Fisher's exact p = 0.0064
In this case, T2 is tracking the evolution of an ancestral state of not-N (!N, any other amino acid), to N, at position 325.

Odds Ratio = 0: for T2, OR < 1 indicates an amino acid associated with resistance

| | | gp120 Binding AUC | | | | | | | | | Neutralization IC50 | | | | | | | | |
|---|---|---|---|---|---|---|---|---|---|---|---|---|---|---|---|---|---|---|---|
| **Boost** | **Subject.day.clone** | **UCA** | **IA4** | **IA3** | **IA2** | **I** | **IA1** | **4** | **5** | **6** | **UCA** | **IA4** | **IA3** | **IA2** | **I** | **IA1** | **4** | **5** | **V1 loop length** |
| i. | CH848.0949.10.17 | 0 | 2.5 | 6.3 | 9.4 | 12.9 | 13.6 | 14.3 | 14.6 | 14.3 | >50 | 0.64 | 0.2 | 0.14 | 0.18 | <0.02 | 0.03 | 0.05 | 17 |
| ii. | CH848.0836.10.31 | 0 | 0.0 | 4.9 | 9.4 | 13.2 | 13.5 | 13.2 | 14.5 | 14.2 | >50 | 45.68 | 0.07 | <0.02 | <0.02 | <0.02 | <0.02 | <0.02 | 17 |
| iii. | CH848.0358.80.06 | 0 | 0.0 | 0.0 | 0.3 | 11.2 | 13.5 | 14.9 | 15.0 | 13.9 | >50 | >50 | >50 | >50 | 1.3 | 0.02 | <0.02 | <0.02 | 24 |
| iii. | CH848.1432.5.41 | 0 | 0.0 | 0.0 | 0.8 | 11.7 | 12.7 | 12.7 | 14.6 | 14.0 | >50 | >50 | >50 | >50 | 2.6 | 0.33 | 0.26 | 0.21 | 30 |
| iii. | CH848.0526.25.02 | 0 | 0.0 | 0.0 | 0.0 | 8.8 | 12.0 | 13.6 | 13.8 | 13.6 | >50 | >50 | >50 | >50 | 16.7 | 1.4 | 1.1 | 1.6 | 34 |

Figure 37D

| | BINDING (LogAUC) | | | | | | | | | | | Neutralization (IC50, ug/ml) | | | | | | | | | | V1 loop length |
|---|---|---|---|---|---|---|---|---|---|---|---|---|---|---|---|---|---|---|---|---|---|---|
| Subject.day.clone | DH270.UCA | DH270.IA4 | DH270.IA3 | DH270.IA2 | DH270.I | DH270.3 | DH270.2 | DH270.IA1 | DH270.4 | DH270.5 | DH270.6 | DH270.UCA | DH270.IA4 | DH270.IA3 | DH270.IA2 | DH270.1 | DH270.3 | DH270.2 | DH270.IA1 | DH270.4 | DH270.5 | |
| **CH848.0949.10.17** | 0 | 2.484 | 6.311 | 9.4 | 12.9 | 13.25 | 13.39 | 13.61 | 14.35 | 14.63 | 14.29 | >50 | 0.64 | 0.20 | 0.14 | 0.18 | <0.02 | 0.06 | <0.02 | 0.03 | 0.05 | 17 |
| CH848.0794.05.41 | 0 | 0 | 0.685 | 4.705 | 12.05 | 8.878 | 11.98 | 12.63 | 13.38 | 13.48 | 14.2 | >50 | >50 | 1.68 | 0.32 | <0.02 | 1.82 | 0.04 | <0.02 | <0.02 | 0.03 | 17 |
| CH848.0358.80.06 | 0 | 0 | 0 | 0.284 | 11.2 | 11.12 | 14.56 | 13.46 | 14.87 | 14.99 | 13.9 | >50 | >50 | >50 | >50 | 1.27 | 0.09 | 0.42 | 0.02 | <0.02 | <0.02 | 24 |
| CH848.0526.25.09 | 0 | 0 | 0 | 0 | 4.326 | 7.18 | 12.3 | 12.19 | 14.07 | 13.57 | 11.55 | >50 | >50 | >50 | >50 | 5.76 | 2.06 | 1.47 | 0.26 | 0.18 | 0.37 | 27 |
| CH848.0526.25.02 | 0 | 0 | 0 | 0 | 8.821 | 9.965 | 12.58 | 11.96 | 13.56 | 13.79 | 13.63 | >50 | >50 | >50 | >50 | 16.71 | >50 | 1.83 | 1.42 | 1.14 | 1.58 | 34 |

2

Aglycone V3-biotin (7)

| Name | SEQ ID NO | Feature |
|---|---|---|
| >HV1301262, CH848.3.D0949.10.17.6R.SOSIP.664 | 323 | |
| >HV1301264, CH848.3.D0949.10.17.6R.DS.SOSIP.664 | 324 | |
| >HV1301263, CH848.3.D0949.10.17chim.6R.DS.SOSIP.664 | 325 | MGSLQPLATLYLLGMLVASVLA (Signal sequence) |
| >HV1301261, CH848.3.D0949.10.17chim.6R.SOSIP.664 | 326 | |
| >CH0848.3.D0949.10.17 gp160 | 327 | MRVMGILKNYPQWWIWGILGFWMLMICNG (Signal sequence) |
| >CH0848.3.D0949.10.17 Delta11 gp120 | 328 | MRVMGILKNYPQWWIWGILGFWMLMICNG (Signal sequence) |

Figure 39B

| Name | SEQ ID NO |
|---|---|
| >HV1301262, CH848.3.D0949.10.17.6R.SOSIP.664 | 329 |
| >HV1301264, CH848.3.D0949.10.17.6R.DS.SOSIP.664 | 330 |
| >HV1301263, CH848.3.D0949.10.17chim.6R.DS.SOSIP.664 | 331 |
| >HV1301261, CH848.3.D0949.10.17chim.6R.SOSIP.664 | 332 |
| >CH0848.3.D0949.10.17 gp160 | 333 |
| >CH0848.3.D0949.10.17 Delta11 gp120 | 334 |

Figure 40A

| Name | SEQ ID NO |
|---|---|
| **>CH0848.3.D0836.10.31 GP160** | 335 |
| >CH0848.3.D0836.10.31 D11 GP120 | 336 |
| >CH0848.3.D0836.10.31CHIM.6R.SOSIP.664 | 337 |
| >CH0848.3.D0836.10.31CHIM.DS.6R.SOSIP.664 | 338 |
| **>CH0848.3.D0836.10.31CHIM.6R.SOSIP.664V4.1** | 339 |
| >CH0848.3.D0836.10.31CHIM.6R.SOSIP.664V4.2 | 340 |
| **>CH0848.3.D0358.80.06 GP160** | 341 |
| >CH0848.3.D0358.80.06 D11 GP120 | 342 |
| >CH0848.3.D0358.80.06CHIM.6R.SOSIP.664 | 343 |
| >CH0848.3.D0358.80.06CHIM.DS.6R.SOSIP.664 | 344 |
| >CH0848.3.D0358.80.06CHIM.6R.SOSIP.664V4.1 | 345 |
| >CH0848.3.D0358.80.06CHIM.6R.SOSIP.664V4.2 | 346 |
| **>CH848.3.D0794.5.41 GP160** | 347 |
| >CH848.3.D0794.5.41 D11 GP120 | 348 |
| >CH848.3.D0794.5.41 CHIM.6R.SOSIP.664 | 349 |
| > CH848.3.D0794.5.41 CHIM.DS.6R.SOSIP.664 | 350 |
| >CH848.3.D0794.5.41 CHIM.6R.SOSIP.664V4.1 | 351 |
| >CH848.3.D0794.5.41 CHIM.6R.SOSIP.664V4.2 | 352 |
| **>CH848.3.D0526.25.09 GP160** | 353 |
| >CH848.3.D0526.25.09 D11 GP120 | 354 |
| >CH848.3.D0526.25.09 CHIM.6R.SOSIP.664 | 355 |
| >CH848.3.D0526.25.09 CHIM.DS.6R.SOSIP.664 | 356 |
| >CH848.3.D0526.25.09 CHIM.6R.SOSIP.664V4.1 | 357 |
| >CH848.3.D0526.25.09 CHIM.6R.SOSIP.664V4.2 | 358 |
| **>CH848.3.D0526.25.02 GP160** | 359 |

Figure 40A continued

| Name | SEQ ID NO |
|---|---|
| >CH848.3.D0526.25.02 D11 GP120 | 360 |
| >CH848.3.D0526.25.02CHIM.6R.SOSIP.664 | 361 |
| >CH848.3.D0526.25.02CHIM.DS.6R.SOSIP.664 | 362 |
| >CH848.3.D0526.25.02CHIM.6R.SOSIP.664V4.1 | 363 |
| >CH848.3.D0526.25.02CHIM.6R.SOSIP.664V4.2 | 364 |
| **>CH848.3.D1432.5.41 GP160** | 365 |
| >HV1300954 CH848.3.D1432.5.41 D11 GP120 | 366 |
| >CH848.3.D1432.5.41CHIM.6R.SOSIP.664 | 367 |
| >CH848.3.D1432.5.41CHIM.DS.6R.SOSIP.664 | 368 |
| >CH848.3.D1432.5.41CHIM.6R.SOSIP.664V4.1 | 369 |
| >CH848.3.D1432.5.41CHIM.6R.SOSIP.664V4.2 | 370 |

Figure 40B

| Name | SEQ ID NO |
|---|---|
| >CH0848.3.D0836.10.31 GP160 | 371 |
| >CH0848.3.D0836.10.31 D11 GP120 | 372 |
| >CH0848.3.D0836.10.31CHIM.6R.SOSIP.664 | 373 |
| >CH0848.3.D0836.10.31CHIM.DS.6R.SOSIP.664 | 374 |
| >CH0848.3.D0836.10.31CHIM.6R.SOSIP.664V4.1 | 375 |
| >CH0848.3.D0836.10.31CHIM.6R.SOSIP.664V4.2 | 376 |
| >CH0848.3.D0358.80.06 GP160 | 377 |
| >CH0848.3.D0358.80.06 D11 GP120 | 378 |
| >CH0848.3.D0358.80.06CHIM.6R.SOSIP.664 | 379 |
| >CH0848.3.D0358.80.06CHIM.DS.6R.SOSIP.664 | 380 |
| >CH0848.3.D0358.80.06CHIM.6R.SOSIP.664V4.1 | 381 |
| >CH0848.3.D0358.80.06CHIM.6R.SOSIP.664V4.2 | 382 |
| >CH848.3.D0794.5.41 GP160 | 383 |
| >CH848.3.D0794.5.41 D11 GP120 | 384 |
| >CH848.3.D0794.5.41 CHIM.6R.SOSIP.664 | 385 |
| > CH848.3.D0794.5.41 CHIM.DS.6R.SOSIP.664 | 386 |
| >CH848.3.D0794.5.41 CHIM.6R.SOSIP.664V4.1 | 387 |
| >CH848.3.D0794.5.41 CHIM.6R.SOSIP.664V4.2 | 388 |
| >CH848.3.D0526.25.09 GP160 | 389 |
| >CH848.3.D0526.25.09 D11 GP120 | 390 |
| >CH848.3.D0526.25.09 CHIM.6R.SOSIP.664 | 391 |
| >CH848.3.D0526.25.09 CHIM.DS.6R.SOSIP.664 | 392 |
| >CH848.3.D0526.25.09 CHIM.6R.SOSIP.664V4.1 | 393 |
| >CH848.3.D0526.25.09 CHIM.6R.SOSIP.664V4.2 | 394 |
| >CH848.3.D0526.25.02 GP160 | 395 |

Figure 40B continued

| Name | SEQ ID NO |
|---|---|
| >CH848.3.D0526.25.02 D11 GP120 | 396 |
| >CH848.3.D0526.25.02CHIM.6R.SOSIP.664 | 397 |
| >CH848.3.D0526.25.02CHIM.DS.6R.SOSIP.664 | 398 |
| >CH848.3.D0526.25.02CHIM.6R.SOSIP.664V4.1 | 399 |
| >CH848.3.D0526.25.02CHIM.6R.SOSIP.664V4.2 | 400 |
| >CH848.3.D1432.5.41 GP160 | 401 |
| >HV1300954  CH848.3.D1432.5.41 D11 GP120 | 402 |
| >CH848.3.D1432.5.41CHIM.6R.SOSIP.664 | 403 |
| >CH848.3.D1432.5.41CHIM.DS.6R.SOSIP.664 | 404 |
| >CH848.3.D1432.5.41CHIM.6R.SOSIP.664V4.1 | 405 |
| >CH848.3.D1432.5.41CHIM.6R.SOSIP.664V4.2 | 406 |

Figure 40C

| Name | SEQ ID NO |
| --- | --- |
| >CH0848.3.d0000.TF | 407 |

Figure 41A

| Name | SEQ ID NO |
|---|---|
| >CH0848.3.D1120.10.21 GP160 | 408 |
| >CH0848.3.D0949.10.18 GP160 | 409 |
| >CH0848.3.D1432.5.27 GP160 | 410 |
| >CH0848.3.D1432.5.27 D11 GP120 | 411 |
| >CH0848.3.D0949.10.18 D11 GP120 | 412 |
| >CH0848.3.D1120.10.21 D11 GP120 | 413 |
| >CH0848.3.D1120.10.21CHIM.6R.SOSIP.664 | 414 |
| >CH0848.3.D1120.10.21CHIM.DS.6R.SOSIP.664 | 415 |
| >CH0848.3.D1120.10.21CHIM.6R.SOSIP.664V4.1 | 416 |
| >CH0848.3.D1120.10.21CHIM.6R.SOSIP.664V4.2 | 417 |
| >CH0848.3.D1432.5.27CHIM.6R.SOSIP.664 | 418 |
| >CH0848.3.D1432.5.27CHIM.DS.6R.SOSIP.664 | 419 |
| >CH0848.3.D1432.5.27CHIM.6R.SOSIP.664V4.1 | 420 |
| >CH0848.3.D1432.5.27CHIM.6R.SOSIP.664V4.2 | 421 |
| >CH0848.3.D0949.10.18CHIM.6R.SOSIP.664 | 422 |
| >CH0848.3.D0949.10.18CHIM.DS.6R.SOSIP.664 | 423 |
| > CH0848.3.D0949.10.18CHIM.6R.SOSIP.664V4.1 | 424 |
| >CH0848.3.D0949.10.18CHIM.6R.SOSIP.664V4.2 | 425 |
| >CH848.3.D0949.10.17CHIM.6R.SOSIP.664V4.1 (annotated sequence in Figure 5C) | 426 |
| >CH848.3.D0949.10.17CHIM.6R.SOSIP.664V4.2 | 427 |

Figure 41B

| Name | SEQ ID NO |
|---|---|
| >CH0848.3.D1120.10.21 GP160 | 428 |
| >CH0848.3.D0949.10.18 GP160 | 429 |
| >CH0848.3.D1432.5.27 GP160 | 430 |
| >CH0848.3.D1432.5.27 D11 GP120 | 431 |
| >CH0848.3.D0949.10.18 D11 GP120 | 432 |
| >CH0848.3.D1120.10.21 D11 GP120 | 433 |
| >CH0848.3.D1120.10.21CHIM.6R.SOSIP.664 | 434 |
| >CH0848.3.D1120.10.21CHIM.DS.6R.SOSIP.664 | 435 |
| >CH0848.3.D1120.10.21CHIM.6R.SOSIP.664V4.1 | 436 |
| >CH0848.3.D1120.10.21CHIM.6R.SOSIP.664V4.2 | 437 |
| >CH0848.3.D1432.5.27CHIM.6R.SOSIP.664 | 438 |
| >CH0848.3.D1432.5.27CHIM.DS.6R.SOSIP.664 | 439 |
| >CH0848.3.D1432.5.27CHIM.6R.SOSIP.664V4.1 | 440 |
| >CH0848.3.D1432.5.27CHIM.6R.SOSIP.664V4.2 | 441 |
| >CH0848.3.D0949.10.18CHIM.6R.SOSIP.664 | 442 |
| >CH0848.3.D0949.10.18CHIM.DS.6R.SOSIP.664 | 443 |
| > CH0848.3.D0949.10.18CHIM.6R.SOSIP.664V4.1 | 444 |
| >CH0848.3.D0949.10.18CHIM.6R.SOSIP.664V4.2 | 445 |
| >CH848.3.D0949.10.17CHIM.6R.SOSIP.664V4.1 | 446 |
| >CH848.3.D0949.10.17CHIM.6R.SOSIP.664V4.2 | 447 |

Figure 41C

>CH848.3.D0949.10.17CHIM.6R.SOSIP.664V4.1 annotated

*Human CD5 leader sequence: MPMGSLQPLATLYLLGMLVASVLA;*
Amino acids from strain BG505;
Start of gp41 from BG505;
Sequence between right and left arrows is from CH848 except for the v4.1 mutations;
V4.1 mutation shows the position of the lysine mutation correspondnng to E64K and the position of the A316W mutation (See de Taeye et al. (2015) Cell 163, 1702-1715.

*MPMGSLQPLATLYLLGMLVASVLA*AENLWVTVYYGVPVWKEAKTTLFCASDARAYEKKVHNVWATHACVPTDPSPQELVLGNVTENFNMWKNDMVDQMHEDIIS

LWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDET

FNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKV

GIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGG

TNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQH

LLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD*

Figure 42

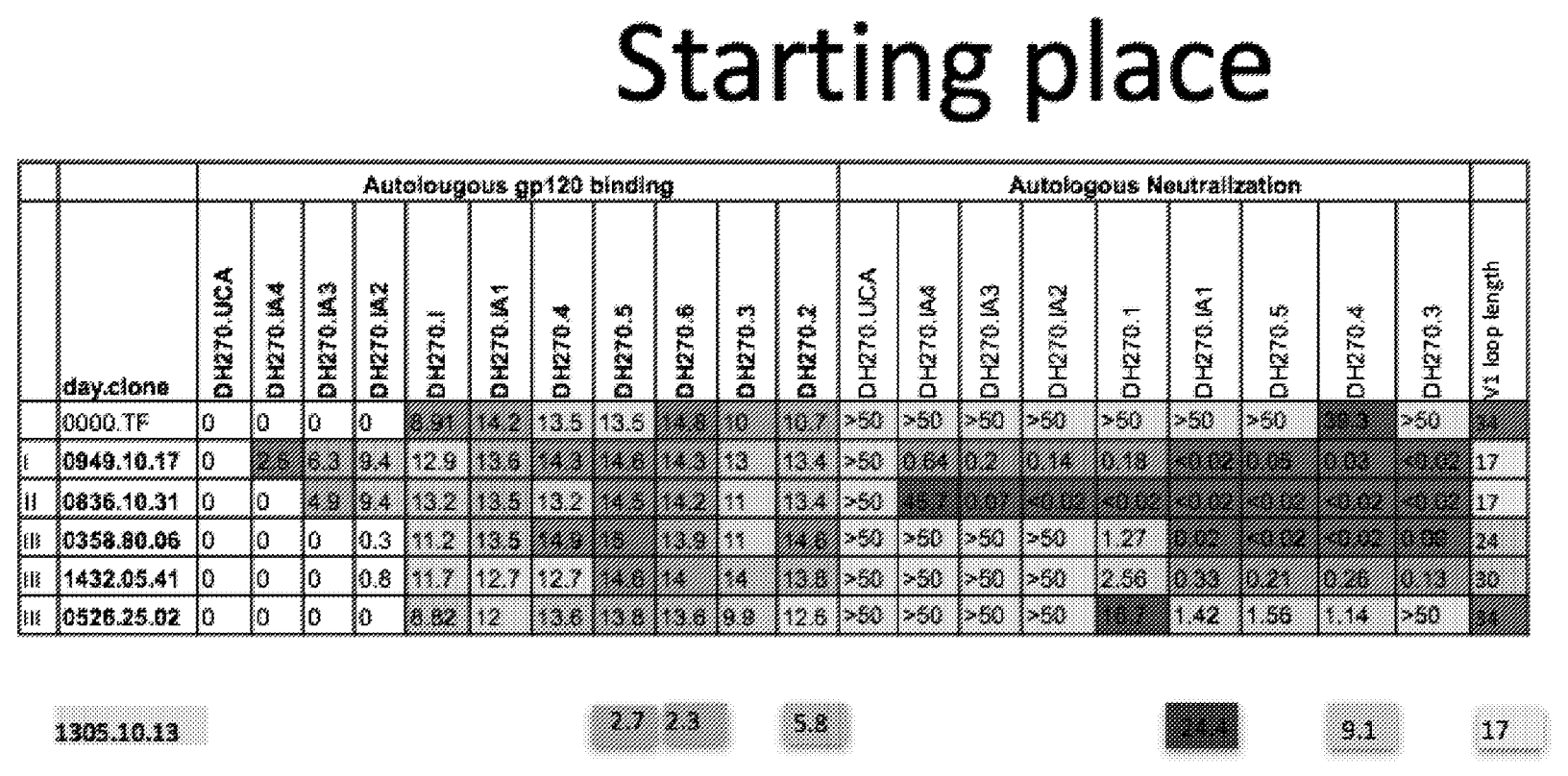

Starting place

| | | Autologous gp120 binding | | | | | | | | | | | Autologous Neutralization | | | | | | | | | | |
|---|---|---|---|---|---|---|---|---|---|---|---|---|---|---|---|---|---|---|---|---|---|---|
| | day.clone | DH270.UCA | DH270.IA4 | DH270.IA3 | DH270.IA2 | DH270.I | DH270.IA1 | DH270.4 | DH270.5 | DH270.6 | DH270.3 | DH270.2 | DH270.UCA | DH270.IA4 | DH270.IA3 | DH270.IA2 | DH270.1 | DH270.IA1 | DH270.5 | DH270.4 | DH270.3 | V1 loop length |
| | 0000.TF | 0 | 0 | 0 | 0 | 8.91 | 14.2 | 13.5 | 13.5 | 14.8 | 10 | 10.7 | >50 | >50 | >50 | >50 | >50 | >50 | >50 | [illegible] | >50 | 34 |
| I | 0949.10.17 | 0 | 2.6 | 6.3 | 9.4 | 12.9 | 13.6 | 14.3 | 14.6 | 14.3 | 13 | 13.4 | >50 | 0.64 | 0.2 | 0.14 | 0.18 | <0.02 | 0.05 | 0.03 | <0.02 | 17 |
| II | 0836.10.31 | 0 | 0 | 4.9 | 9.4 | 13.2 | 13.5 | 13.2 | 14.5 | 14.2 | 11 | 13.4 | >50 | [illegible] | 0.07 | <0.02 | <0.02 | <0.02 | <0.02 | <0.02 | <0.02 | 17 |
| III | 0358.80.06 | 0 | 0 | 0 | 0.3 | 11.2 | 13.5 | 14.9 | 15 | 13.9 | 11 | 14.6 | >50 | >50 | >50 | >50 | 1.27 | 0.02 | <0.02 | <0.02 | 0.06 | 24 |
| III | 1432.05.41 | 0 | 0 | 0 | 0.8 | 11.7 | 12.7 | 12.7 | 14.6 | 14 | 14 | 13.8 | >50 | >50 | >50 | >50 | 2.56 | 0.33 | 0.21 | 0.26 | 0.13 | 30 |
| III | 0526.25.02 | 0 | 0 | 0 | 0 | 8.82 | 12 | 13.6 | 13.8 | 13.6 | 9.9 | 12.6 | >50 | >50 | >50 | >50 | [illegible] | 1.42 | 1.56 | 1.14 | >50 | 34 |
| | 1305.10.13 | | | | | | | | 2.7 | 2.3 | | 5.8 | | | | | | [illegible] | | 9.1 | | 17 |

Figure 43 contacts

| | | |
|---|---|---|
| | | iOylOOctrp nOntgdigdi rghOgOitc |
| CH0848.0949.10.17 | D | m----y---- ----di---- k-------- |
| CH0848.0836.10.31 | D | m----y---- ----di---- --------- |
| CH0848.0358.80.06 | D | m----y---- g---di---- --------- |
| CH0848.1432.5.41 | D | m----y---- ----di---p -k------- |
| CH0848.0526.25.02 | D | m----y---- g---di---- --------- |
| CH0848.1305.10.13 | N | m----y---- ----di--np --------- |

1305 is one of 2 CH848 Envs with D325N that has some binding affinity and sensitivity to DH270 lineage antibodies

Figure 44A

>703010848.3.d0949.10.17_signature_opt_b gp160
TRVMGILKNYPQWWIWGILGFWMLMICNGKGKLWVTVYYGVPVWKEAKTTLFCASDARAYEKEVH
NVWATHACVPTDPSPQELVLGNVTENFNMWKNDMVDQMHEDIISLWDQSLKPCVKLTPLCVTLIC
SNATVKNGTVEEMKNCSFNTTTEIRDKEKKEYALFYKPDIVPISETNNTSEYRLINCDTSAVTQA
CPKVTFEPIPIHYCAPAGYAILKCNNETFNGTGPCTNVSTVQCTHGIRPVVSTQLLLNGSLAEKE
IVIRSENLTNNAKIIIVHLKTPVEINCTRPNNNTRKSIRIGPGQTFYATGDIIGDIKQAHCNISE
AKWNDTLQNVSIELQKHFPNKTIKYNQSAGGDMEITTHSFNCGGEFFYCDTSNLFNGTYNGTYIS
TNSSANSTSTITLQCRIKQIINMWQGVGRAMYAPPIAGNITCRSSITGLLLTRDGGTNSNETETF
RPAGGDMRDNWRSELYKYKVVEIQPLGIAPTGAKRRVVEREKRAAGLGALFLGFLGAAGSTMGAA
SITLTVQARQLLSGIVQQQSNLLRAIEAQQHMLQLTVWGIKQLQARVLAIERYLKDQQLLGMWGC
SGKLICTTNVPWNASWSNKSETDIWDNMTWMQWEREISNYTETIYKLLEDSQNQQERNEQDLLAL
DSWNSLWNWFNITKWLWYIKIFIMIVGGLIGLRIVFAVLSIVNRVRQGYSPLSLQTLTPNPREPD
RLRGIEEEGGEQDRDRSGRLVHGFLPIVWDDLRSLCLFSYHQLRDLLLLAARVVELLGRSSLRGL
QRGWEVLKYLGSLVQYWGLELKKSAISLFDTLAIAVAEGTDRIIELIQRICRAIRNIPTRIRQGF
EASLL

1. Replace signal peptide with CD5

>703010848.3.d0949.10.17_signature_opt_b_CD5ss gp160
MPMGSLQPLATLYLLGMLVASCLG*KGKLWVTVYYG*VPVWKEAKTTLFCASDARAYEKEVHNVWAT
HACVPTDPSPQELVLGNVTENFNMWKNDMVDQMHEDIISLWDQSLKPCVKLTPLCVTLICSNATV
KNGTVEEMKNCSFNTTTEIRDKEKKEYALFYKPDIVPISETNNTSEYRLINCDTSAVTQACPKVT
FEPIPIHYCAPAGYAILKCNNETFNGTGPCTNVSTVQCTHGIRPVVSTQLLLNGSLAEKEIVIRS
ENLTNNAKIIIVHLKTPVEINCTRPNNNTRKSIRIGPGQTFYATGDIIGDIKQAHCNISEAKWND
TLQNVSIELQKHFPNKTIKYNQSAGGDMEITTHSFNCGGEFFYCDTSNLFNGTYNGTYISTNSSA
NSTSTITLQCRIKQIINMWQGVGRAMYAPPIAGNITCRSSITGLLLTRDGGTNSNETETFRPAGG
DMRDNWRSELYKYKVVEIQPLGIAPTGAKRRVVEREKRAAGLGALFLGFLGAAGSTMGAASITLT
VQARQLLSGIVQQQSNLLRAIEAQQHMLQLTVWGIKQLQARVLAIERYLKDQQLLGMWGCSGKLI
CTTNVPWNASWSNKSETDIWDNMTWMQWEREISNYTETIYKLLEDSQNQQERNEQDLLALDSWNS
LWNWFNITKWLWYIKIFIMIVGGLIGLRIVFAVLSIVNRVRQGYSPLSLQTLTPNPREPDRLRGI
EEEGGEQDRDRSGRLVHGFLPIVWDDLRSLCLFSYHQLRDLLLLAARVVELLGRSSLRGLQRGWE
VLKYLGSLVQYWGLELKKSAISLFDTLAIAVAEGTDRIIELIQRICRAIRNIPTRIRQGFEASLL

2. Delete N-terminal residues

>703010848.3.d0949.10.17_signature_opt_b_CD5ss delta11 gp160
MPMGSLQPLATLYLLGMLVASCLGVPVWKEAKTTLFCASDARAYEKEVHNVWATHACVPTDPSPQ
ELVLGNVTENFNMWKNDMVDQMHEDIISLWDQSLKPCVKLTPLCVTLICSNATVKNGTVEEMKNC
SFNTTTEIRDKEKKEYALFYKPDIVPISETNNTSEYRLINCDTSAVTQACPKVTFEPIPIHYCAP
AGYAILKCNNETFNGTGPCTNVSTVQCTHGIRPVVSTQLLLNGSLAEKEIVIRSENLTNNAKIII
VHLKTPVEINCTRPNNNTRKSIRIGPGQTFYATGDIIGDIKQAHCNISEAKWNDTLQNVSIELQK
HFPNKTIKYNQSAGGDMEITTHSFNCGGEFFYCDTSNLFNGTYNGTYISTNSSANSTSTITLQCR
IKQIINMWQGVGRAMYAPPIAGNITCRSSITGLLLTRDGGTNSNETETFRPAGGDMRDNWRSELY
KYKVVEIQPLGIAPTGAKRRVVEREKRAAGLGALFLGFLGAAGSTMGAASITLTVQARQLLSGIV
QQQSNLLRAIEAQQHMLQLTVWGIKQLQARVLAIERYLKDQQLLGMWGCSGKLICTTNVPWNASW
SNKSETDIWDNMTWMQWEREISNYTETIYKLLEDSQNQQERNEQDLLALDSWNSLWNWFNITKWL
WYIKIFIMIVGGLIGLRIVFAVLSIVNRVRQGYSPLSLQTLTPNPREPDRLRGIEEEGGEQDRDR
SGRLVHGFLPIVWDDLRSLCLFSYHQLRDLLLLAARVVELLGRSSLRGLQRGWEVLKYLGSLVQY
WGLELKKSAISLFDTLAIAVAEGTDRIIELIQRICRAIRNIPTRIRQGFEASLL

3. Mutate furin site

>703010848.3.d0949.10.17_signature_opt_b_CD5ss delta11 gp160C
MPMGSLQPLATLYLLGMLVASCLGVPVWKEAKTTLFCASDARAYEKEVHNVWATHACVPTDPSPQ
ELVLGNVTENFNMWKNDMVDQMHEDIISLWDQSLKPCVKLTPLCVTLICSNATVKNGTVEEMKNC
SFNTTTEIRDKEKKEYALFYKPDIVPISETNNTSEYRLINCDTSAVTQACPKVTFEPIPIHYCAP

Figure 44A continued

AGYAILKCNNETFNGTGPCTNVSTVQCTHGIRPVVSTQLLLNGSLAEKEIVIRSENLTNNAKIII
VHLKTPVEINCTRPNNNTRKSIRIGPGQTFYATGDIIGDIKQAHCNISEAKWNDTLQNVSIELQK
HFPNKTIKYNQSAGGDMEITTHSFNCGGEFFYCDTSNLFNGTYNGTYISTNSSANSTSTITLQCR
IKQIINMWQGVGRAMYAPPIAGNITCRSSITGLLLTRDGGTNSNETETFRPAGGDMRDNWRSELY
KYKVVEIQPLGIAPTGAKERVVEREKEAAGLGALFLGFLGAAGSTMGAASITLTVQARQLLSGIV
QQQSNLLRAIEAQQHMLQLTVWGIKQLQARVLAIERYLKDQQLLGMWGCSGKLICTTNVPWNASW
SNKSETDIWDNMTWMQWEREISNYTETIYKLLEDSQNQQERNEQDLLALDSWNSLWNWFNITKWL
WYIKIFIMIVGGLIGLRIVFAVLSIVNRVRQGYSPLSLQTLTPNPREPDRLRGIEEEGGEQDRDR
SGRLVHGFLPIVWDDLRSLCLFSYHQLRDLLLLAARVVELLGRSSLRGLQRGWEVLKYLGSLVQY
WGLELKKSAISLFDTLAIAVAEGTDRIIELIQRICRAIRNIPTRIRQGFEASLL

4. Truncate to gp120

>703010848.3.d0949.10.17_signature_opt_b_CD5ss delta11 gp120
MPMGSLQPLATLYLLGMLVASCLGVPVWKEAKTTLFCASDARAYEKEVHNVWATHACVPTDPSPQ
ELVLGNVTENFNMWKNDMVDQMHEDIISLWDQSLKPCVKLTPLCVTLICSNATVKNGTVEEMKNC
SFNTTTEIRDKEKKEYALFYKPDIVPISETNNTSEYRLINCDTSAVTQACPKVTFEPIPIHYCAP
AGYAILKCNNETFNGTGPCTNVSTVQCTHGIRPVVSTQLLLNGSLAEKEIVIRSENLTNNAKIII
VHLKTPVEINCTRPNNNTRKSIRIGPGQTFYATGDIIGDIKQAHCNISEAKWNDTLQNVSIELQK
HFPNKTIKYNQSAGGDMEITTHSFNCGGEFFYCDTSNLFNGTYNGTYISTNSSANSTSTITLQCR
IKQIINMWQGVGRAMYAPPIAGNITCRSSITGLLLTRDGGTNSNETETFRPAGGDMRDNWRSELY
KYKVVEIQPLGIAPTGAKERVVEREKE

5. Codon optimize sequence with liao codon converter

>703010848.3.d0949.10.17_signature_opt_b_CD5ss delta11 gp120
ATGCCCATGGGCTCCCTGCAGCCCCTGGCCACCCTGTACCTGCTGGGCATGCTGGTGGC
CTCCTGCCTGGGCGTGCCCGTGTGGAAGGAGGCCAAGACCACCCTGTTCTGCGCCTCCG
ACGCCCGCGCCTACGAGAAGGAGGTGCACAACGTGTGGGCCACCCACGCCTGCGTGCCC
ACCGACCCCTCCCCCCAGGAGCTGGTGCTGGGCAACGTGACCGAGAACTTCAACATGTG
GAAGAACGACATGGTGGACCAGATGCACGAGGACATCATCTCCCTGTGGGACCAGTCCC
TGAAGCCCTGCGTGAAGCTGACCCCCCTGTGCGTGACCCTGATCTGCTCCAACGCCACC
GTGAAGAACGGCACCGTGGAGGAGATGAAGAACTGCTCCTTCAACACCACCACCGAGAT
CCGCGACAAGGAGAAGAAGGAGTACGCCCTGTTCTACAAGCCCGACATCGTGCCCATCT
CCGAGACCAACAACACCTCCGAGTACCGCCTGATCAACTGCGACACCTCCGCCGTGACC
CAGGCCTGCCCCAAGGTGACCTTCGAGCCCATCCCCATCCACTACTGCGCCCCCGCCGG
CTACGCCATCCTGAAGTGCAACAACGAGACCTTCAACGGCACCGGCCCCTGCACCAACG
TGTCCACCGTGCAGTGCACCCACGGCATCCGCCCCGTGGTGTCCACCCAGCTGCTGCTG
AACGGCTCCCTGGCCGAGAAGGAGATCGTGATCCGCTCCGAGAACCTGACCAACAACGC
CAAGATCATCATCGTGCACCTGAAGACCCCCGTGGAGATCAACTGCACCCGCCCCAACA
ACAACACCCGCAAGTCCATCCGCATCGGCCCCGGCCAGACCTTCTACGCCACCGGCGAC
ATCATCGGCGACATCAAGCAGGCCCACTGCAACATCTCCGAGGCCAAGTGGAACGACAC
CCTGCAGAACGTGTCCATCGAGCTGCAGAAGCACTTCCCCAACAAGACCATCAAGTACA
ACCAGTCCGCCGGCGGCGACATGGAGATCACCACCCACTCCTTCAACTGCGGCGGCGAG
TTCTTCTACTGCGACACCTCCAACCTGTTCAACGGCACCTACAACGGCACCTACATCTC
CACCAACTCCTCCGCCAACTCCACCTCCACCATCACCCTGCAGTGCCGCATCAAGCAGA
TCATCAACATGTGGCAGGGCGTGGGCCGCGCCATGTACGCCCCCCCCATCGCCGGCAAC
ATCACCTGCCGCTCCTCCATCACCGGCCTGCTGCTGACCCGCGACGGCGGCACCAACTC
CAACGAGACCGAGACCTTCCGCCCCGCCGGCGGCGACATGCGCGACAACTGGCGCTCCG
AGCTGTACAAGTACAAGGTGGTGGAGATCCAGCCCCTGGGCATCGCCCCCACCGGCGCC
AAGGAGCGCGTGGTGGAGCGCGAGAAGGAG

Figure 44B

>703010848.3.d0949.10.17_signature_opt_filled_rare_holes_a gp160
TRVMGILKNYPQWWIWGILGFWMLMICNGKGKLWVTVYYGVPVWKEAKTTLFCASDARAYEKEVH
NVWATHACVPTDPSPQELVLGNVTENFNMWKNDMVDQMHEDIISLWDQSLKPCVKLTPLCVTLIC
SNATVKNGTVEEMKNCSFNTTTEIRDKEKKEYALFYKPDIVPISETNNTSEYRLINCNTSAVTQA
CPKVTFEPIPIHYCAPAGYAILKCNNETFNGTGPCTNVSTVQCTHGIRPVVSTQLLLNGSLAEKE
IVIRSENLTNNAKIIIVHLNTSVEINCTRPNNNTRKSIRIGPGQTFYATGDIIGDIKQAHCNISE
AKWNDTLQNVSIELQKHFPNKTIKYNQSAGGDMEITTHSFNCGGEFFYCNTSNLFNGTYNGTYIS
TNSSANSTSTITLQCRIKQIINMWQGVGRAMYAPPIAGNITCRSSITGLLLTRDGGTNSNETETF
RPAGGDMRDNWRSELYKYKVVEIQPLGIAPTGAKRRVVEREKRAAGLGALFLGFLGAAGSTMGAA
SITLTVQARQLLSGIVQQQSNLLRAIEAQQHMLQLTVWGIKQLQARVLAIERYLKDQQLLGMWGC
SGKLICTTNVPWNASWSNKSETDIWDNMTWMQWEREISNYTETIYKLLEDSQNQQERNEQDLLAL
DSWNSLWNWFNITKWLWYIKIFIMIVGGLIGLRIVFAVLSIVNRVRQGYSPLSLQTLTPNPREPD
RLRGIEEEGGEQDRDRSGRLVHGFLPIVWDDLRSLCLFSYHQLRDLLLLAARVVELLGRSSLRGL
QRGWEVLKYLGSLVQYWGLELKKSAISLFDTLAIAVAEGTDRIIELIQRICRAIRNIPTRIRQGF
EASLL

1. Replace signal peptide with CD5

>703010848.3.d0949.10.17_signature_opt_filled_rare_holes_a_CD5ss gp160
MPMGSLQPLATLYLLGMLVASCLG*KGKLWVTVYYG*VPVWKEAKTTLFCASDARAYEKEVHNVWAT
HACVPTDPSPQELVLGNVTENFNMWKNDMVDQMHEDIISLWDQSLKPCVKLTPLCVTLICSNATV
KNGTVEEMKNCSFNTTTEIRDKEKKEYALFYKPDIVPISETNNTSEYRLINCNTSAVTQACPKVT
FEPIPIHYCAPAGYAILKCNNETFNGTGPCTNVSTVQCTHGIRPVVSTQLLLNGSLAEKEIVIRS
ENLTNNAKIIIVHLNTSVEINCTRPNNNTRKSIRIGPGQTFYATGDIIGDIKQAHCNISEAKWND
TLQNVSIELQKHFPNKTIKYNQSAGGDMEITTHSFNCGGEFFYCNTSNLFNGTYNGTYISTNSSA
NSTSTITLQCRIKQIINMWQGVGRAMYAPPIAGNITCRSSITGLLLTRDGGTNSNETETFRPAGG
DMRDNWRSELYKYKVVEIQPLGIAPTGAKRRVVEREKRAAGLGALFLGFLGAAGSTMGAASITLT
VQARQLLSGIVQQQSNLLRAIEAQQHMLQLTVWGIKQLQARVLAIERYLKDQQLLGMWGCSGKLI
CTTNVPWNASWSNKSETDIWDNMTWMQWEREISNYTETIYKLLEDSQNQQERNEQDLLALDSWNS
LWNWFNITKWLWYIKIFIMIVGGLIGLRIVFAVLSIVNRVRQGYSPLSLQTLTPNPREPDRLRGI
EEEGGEQDRDRSGRLVHGFLPIVWDDLRSLCLFSYHQLRDLLLLAARVVELLGRSSLRGLQRGWE
VLKYLGSLVQYWGLELKKSAISLFDTLAIAVAEGTDRIIELIQRICRAIRNIPTRIRQGFEASLL

2. Delete N-terminal residues
>703010848.3.d0949.10.17_signature_opt_filled_rare_holes_a_CD5ss_delta11 gp160
MPMGSLQPLATLYLLGMLVASCLGVPVWKEAKTTLFCASDARAYEKEVHNVWATHACVPTDPSPQ
ELVLGNVTENFNMWKNDMVDQMHEDIISLWDQSLKPCVKLTPLCVTLICSNATVKNGTVEEMKNC
SFNTTTEIRDKEKKEYALFYKPDIVPISETNNTSEYRLINCNTSAVTQACPKVTFEPIPIHYCAP
AGYAILKCNNETFNGTGPCTNVSTVQCTHGIRPVVSTQLLLNGSLAEKEIVIRSENLTNNAKIII
VHLNTSVEINCTRPNNNTRKSIRIGPGQTFYATGDIIGDIKQAHCNISEAKWNDTLQNVSIELQK
HFPNKTIKYNQSAGGDMEITTHSFNCGGEFFYCNTSNLFNGTYNGTYISTNSSANSTSTITLQCR
IKQIINMWQGVGRAMYAPPIAGNITCRSSITGLLLTRDGGTNSNETETFRPAGGDMRDNWRSELY
KYKVVEIQPLGIAPTGAKRRVVEREKRAAGLGALFLGFLGAAGSTMGAASITLTVQARQLLSGIV
QQQSNLLRAIEAQQHMLQLTVWGIKQLQARVLAIERYLKDQQLLGMWGCSGKLICTTNVPWNASW
SNKSETDIWDNMTWMQWEREISNYTETIYKLLEDSQNQQERNEQDLLALDSWNSLWNWFNITKWL
WYIKIFIMIVGGLIGLRIVFAVLSIVNRVRQGYSPLSLQTLTPNPREPDRLRGIEEEGGEQDRDR
SGRLVHGFLPIVWDDLRSLCLFSYHQLRDLLLLAARVVELLGRSSLRGLQRGWEVLKYLGSLVQY
WGLELKKSAISLFDTLAIAVAEGTDRIIELIQRICRAIRNIPTRIRQGFEASLL

3. Mutate furin site

Figure 44B continued

>703010848.3.d0949.10.17_signature_opt_filled_rare_holes_a_CD5ss_deltal1 gp160
MPMGSLQPLATLYLLGMLVASCLGVPVWKEAKTTLFCASDARAYEKEVHNVWATHACVPTDPSPQ
ELVLGNVTENFNMWKNDMVDQMHEDIISLWDQSLKPCVKLTPLCVTLICSNATVKNGTVEEMKNC
SFNTTTEIRDKEKKEYALFYKPDIVPISETNNTSEYRLINCNTSAVTQACPKVTFEPIPIHYCAP
AGYAILKCNNETFNGTGPCTNVSTVQCTHGIRPVVSTQLLLNGSLAEKEIVIRSENLTNNAKIII
VHLNTSVEINCTRPNNNTRKSIRIGPGQTFYATGDIIGDIKQAHCNISEAKWNDTLQNVSIELQK
HFPNKTIKYNQSAGGDMEITTHSFNCGGEFFYCNTSNLFNGTYNGTYISTNSSANSTSTITLQCR
IKQIINMWQGVGRAMYAPPIAGNITCRSSITGLLLTRDGGTNSNETETFRPAGGDMRDNWRSELY
KYKVVEIQPLGIAPTGAKERVVEREKEAAGLGALFLGFLGAAGSTMGAASITLTVQARQLLSGIV
QQQSNLLRAIEAQQHMLQLTVWGIKQLQARVLAIERYLKDQQLLGMWGCSGKLICTTNVPWNASW
SNKSETDIWDNMTWMQWEREISNYTETIYKLLEDSQNQQERNEQDLLALDSWNSLWNWFNITKWL
WYIKIFIMIVGGLIGLRIVFAVLSIVNRVRQGYSPLSLQTLTPNPREPDRLRGIEEEGGEQDRDR
SGRLVHGFLPIVWDDLRSLCLFSYHQLRDLLLLAARVVELLGRSSLRGLQRGWEVLKYLGSLVQY
WGLELKKSAISLFDTLAIAVAEGTDRIIELIQRICRAIRNIPTRIRQGFEASLL

4. Truncate to gp120

>703010848.3.d0949.10.17_signature_opt_filled_rare_holes_a_CD5ss_deltal1 gp120
MPMGSLQPLATLYLLGMLVASCLGVPVWKEAKTTLFCASDARAYEKEVHNVWATHACVPTDPSPQ
ELVLGNVTENFNMWKNDMVDQMHEDIISLWDQSLKPCVKLTPLCVTLICSNATVKNGTVEEMKNC
SFNTTTEIRDKEKKEYALFYKPDIVPISETNNTSEYRLINCNTSAVTQACPKVTFEPIPIHYCAP
AGYAILKCNNETFNGTGPCTNVSTVQCTHGIRPVVSTQLLLNGSLAEKEIVIRSENLTNNAKIII
VHLNTSVEINCTRPNNNTRKSIRIGPGQTFYATGDIIGDIKQAHCNISEAKWNDTLQNVSIELQK
HFPNKTIKYNQSAGGDMEITTHSFNCGGEFFYCNTSNLFNGTYNGTYISTNSSANSTSTITLQCR
IKQIINMWQGVGRAMYAPPIAGNITCRSSITGLLLTRDGGTNSNETETFRPAGGDMRDNWRSELY
KYKVVEIQPLGIAPTGAKERVVEREKE

5. Codon optimize sequence

>703010848.3.d0949.10.17_signature_opt_filled_rare_holes_a_CD5ss_deltal1 gp120
ATGCCCATGGGCTCCCTGCAGCCCCTGGCCACCCTGTACCTGCTGGGCATGCTGGTGGC
CTCCTGCCTGGGCGTGCCCGTGTGGAAGGAGGCCAAGACCACCCTGTTCTGCGCCTCCG
ACGCCCGCGCCTACGAGAAGGAGGTGCACAACGTGTGGGCCACCCACGCCTGCGTGCCC
ACCGACCCCTCCCCCCAGGAGCTGGTGCTGGGCAACGTGACCGAGAACTTCAACATGTG
GAAGAACGACATGGTGGACCAGATGCACGAGGACATCATCTCCCTGTGGGACCAGTCCC
TGAAGCCCTGCGTGAAGCTGACCCCCCTGTGCGTGACCCTGATCTGCTCCAACGCCACC
GTGAAGAACGGCACCGTGGAGGAGATGAAGAACTGCTCCTTCAACACCACCACCGAGAT
CCGCGACAAGGAGAAGAAGGAGTACGCCCTGTTCTACAAGCCCGACATCGTGCCCATCT
CCGAGACCAACAACACCTCCGAGTACCGCCTGATCAACTGCAACACCTCCGCCGTGACC
CAGGCCTGCCCCAAGGTGACCTTCGAGCCCATCCCCATCCACTACTGCGCCCCCGCCGG
CTACGCCATCCTGAAGTGCAACAACGAGACCTTCAACGGCACCGGCCCCTGCACCAACG
TGTCCACCGTGCAGTGCACCCACGGCATCCGCCCCGTGGTGTCCACCCAGCTGCTGCTG
AACGGCTCCCTGGCCGAGAAGGAGATCGTGATCCGCTCCGAGAACCTGACCAACAACGC
CAAGATCATCATCGTGCACCTGAACACCTCCGTGGAGATCAACTGCACCCGCCCCAACA
ACAACACCCGCAAGTCCATCCGCATCGGCCCCGGCCAGACCTTCTACGCCACCGGCGAC
ATCATCGGCGACATCAAGCAGGCCCACTGCAACATCTCCGAGGCCAAGTGGAACGACAC
CCTGCAGAACGTGTCCATCGAGCTGCAGAAGCACTTCCCCAACAAGACCATCAAGTACA
ACCAGTCCGCCGGCGGCGACATGGAGATCACCACCCACTCCTTCAACTGCGGCGGCGAG
TTCTTCTACTGCAACACCTCCAACCTGTTCAACGGCACCTACAACGGCACCTACATCTC

Figure 44B continued

CACCAACTCCTCCGCCAACTCCACCTCCACCATCACCCTGCAGTGCCGCATCAAGCAGA
TCATCAACATGTGGCAGGGCGTGGGCCGCGCCATGTACGCCCCCCCCATCGCCGGCAAC
ATCACCTGCCGCTCCTCCATCACCGGCCTGCTGCTGACCCGCGACGGCGGCACCAACTC
CAACGAGACCGAGACCTTCCGCCCCGCCGGCGGCGACATGCGCGACAACTGGCGCTCCG
AGCTGTACAAGTACAAGGTGGTGGAGATCCAGCCCCTGGGCATCGCCCCCACCGGCGCC
AAGGAGCGCGTGGTGGAGCGCGAGAAGGAG

TRVMGIPKNYPLWWIWGILGFWMLMNCNGEGNLWVTVYYGVPVWKEAKTTLFCASDAKAYVKEVHNVWAT
HACVPTDPSPQELVLDNVTENFNMWKNDMVDQMHEDIISLWDQSLKPCVKLTPLCVTLNCSNAIVKNSTT
EEISHALARNSTTEEMKNCSFNTTTEIRDKEKKEYALFYRPDIVPLNNKTSNISEYRLINCNTSTVTQAC
PKVTFEPIPIHYCAPAGYAILKCNDETFNGTGPCSNVSTVQCTHGIRPVVSTQLLLNGSLAEKGIVIRSE
NLTNNAKIIIVQLNANASVEIVCTRPNNNTRKSVRIGPGQTFYATGDIIGNIRQAHCNISEKKWNETLQK
VGIELQKHFPNKTIKYNQSAGGDMEITTHSFNCGGEFFYCNTAKLFNSTYNGTYISTNSINSTLNITLQC
RIKQIINMWQGVGRAMYAPPIAGNITCRSNITGLLLTRDGGIHNDSNVTETFRPAGGDMRDNWRSELYKY
KVVEIQPLGIAPTGAKRRVVERGKRAAGLGALFLGFLGAAGSTMGAASITLTVQARQLLSGIVQQQSNLL
RAIEAQQHMLQLTVWGIKQLQARVLALERYLKDQQLLGIWGCSGKLICTTNVPWNTSWSNKSEMDIWNNM
TWMQWEREISNYTGTIYKLLEDSQNQQERNEQDLLALDSWNSLWNWFDITKWLWYIKIFIMIVGGLIGLR
IVFAVLSIVNRVRQGYSPLSLQTLTPNPREPDRLRGIEEEGGEQDRDKSIRLVNGFLPIVWDDLRSLCLF
SYHRLRDFLLLAARVVELLGRSSLRGLQRGWEVLKYLGSLVQYWGLELKKSAISLFDTLAVAVAEGTDRI
IELIQGFCRAIRNIPRRIRQGFEASLL

1. Replace signal peptide with CD5

>CH0848.3.d1651.10.07_CD5ss gp160

MPMGSLQPLATLYLLGMLVASCLG*EGNLWVTVYYG*VPVWKEAKTTLFCASDAKAYVKEVHNVWATHACVP
TDPSPQELVLDNVTENFNMWKNDMVDQMHEDIISLWDQSLKPCVKLTPLCVTLNCSNAIVKNSTTEEISH
ALARNSTTEEMKNCSFNTTTEIRDKEKKEYALFYRPDIVPLNNKTSNISEYRLINCNTSTVTQACPKVTF
EPIPIHYCAPAGYAILKCNDETFNGTGPCSNVSTVQCTHGIRPVVSTQLLLNGSLAEKGIVIRSENLTNN
AKIIIVQLNANASVEIVCTRPNNNTRKSVRIGPGQTFYATGDIIGNIRQAHCNISEKKWNETLQKVGIEL
QKHFPNKTIKYNQSAGGDMEITTHSFNCGGEFFYCNTAKLFNSTYNGTYISTNSINSTLNITLQCRIKQI
INMWQGVGRAMYAPPIAGNITCRSNITGLLLTRDGGIHNDSNVTETFRPAGGDMRDNWRSELYKYKVVEI
QPLGIAPTGAKRRVVERGKRAAGLGALFLGFLGAAGSTMGAASITLTVQARQLLSGIVQQQSNLLRAIEA
QQHMLQLTVWGIKQLQARVLALERYLKDQQLLGIWGCSGKLICTTNVPWNTSWSNKSEMDIWNNMTWMQW
EREISNYTGTIYKLLEDSQNQQERNEQDLLALDSWNSLWNWFDITKWLWYIKIFIMIVGGLIGLRIVFAV
LSIVNRVRQGYSPLSLQTLTPNPREPDRLRGIEEEGGEQDRDKSIRLVNGFLPIVWDDLRSLCLFSYHRL
RDFLLLAARVVELLGRSSLRGLQRGWEVLKYLGSLVQYWGLELKKSAISLFDTLAVAVAEGTDRIIELIQ
GFCRAIRNIPRRIRQGFEASLL

2. Delete N-terminal residues

>CH0848.3.d1651.10.07_CD5ss_Delta11 gp160

MPMGSLQPLATLYLLGMLVASCLGVPVWKEAKTTLFCASDAKAYVKEVHNVWATHACVPTDPSPQELVLD
NVTENFNMWKNDMVDQMHEDIISLWDQSLKPCVKLTPLCVTLNCSNAIVKNSTTEEISHALARNSTTEEM
KNCSFNTTTEIRDKEKKEYALFYRPDIVPLNNKTSNISEYRLINCNTSTVTQACPKVTFEPIPIHYCAPA
GYAILKCNDETFNGTGPCSNVSTVQCTHGIRPVVSTQLLLNGSLAEKGIVIRSENLTNNAKIIIVQLNAN
ASVEIVCTRPNNNTRKSVRIGPGQTFYATGDIIGNIRQAHCNISEKKWNETLQKVGIELQKHFPNKTIKY
NQSAGGDMEITTHSFNCGGEFFYCNTAKLFNSTYNGTYISTNSINSTLNITLQCRIKQIINMWQGVGRAM
YAPPIAGNITCRSNITGLLLTRDGGIHNDSNVTETFRPAGGDMRDNWRSELYKYKVVEIQPLGIAPTGAK
RRVVERGKRAAGLGALFLGFLGAAGSTMGAASITLTVQARQLLSGIVQQQSNLLRAIEAQQHMLQLTVWG
IKQLQARVLALERYLKDQQLLGIWGCSGKLICTTNVPWNTSWSNKSEMDIWNNMTWMQWEREISNYTGTI
YKLLEDSQNQQERNEQDLLALDSWNSLWNWFDITKWLWYIKIFIMIVGGLIGLRIVFAVLSIVNRVRQGY
SPLSLQTLTPNPREPDRLRGIEEEGGEQDRDKSIRLVNGFLPIVWDDLRSLCLFSYHRLRDFLLLAARVV
ELLGRSSLRGLQRGWEVLKYLGSLVQYWGLELKKSAISLFDTLAVAVAEGTDRIIELIQGFCRAIRNIPR
RIRQGFEASLL

3. Mutate furin site

>CH0848.3.d1651.10.07_CD5ss_Delta11 gp160C

MPMGSLQPLATLYLLGMLVASCLGVPVWKEAKTTLFCASDAKAYVKEVHNVWATHACVPTDPSPQELVLD
NVTENFNMWKNDMVDQMHEDIISLWDQSLKPCVKLTPLCVTLNCSNAIVKNSTTEEISHALARNSTTEEM
KNCSFNTTTEIRDKEKKEYALFYRPDIVPLNNKTSNISEYRLINCNTSTVTQACPKVTFEPIPIHYCAPA

Figure 44C continued

GYAILKCNDETFNGTGPCSNVSTVQCTHGIRPVVSTQLLLNGSLAEKGIVIRSENLTNNAKIIIVQLNAN
ASVEIVCTRPNNNTRKSVRIGPGQTFYATGDIIGNIRQAHCNISEKKWNETLQKVGIELQKHFPNKTIKY
NQSAGGDMEITTHSFNCGGEFFYCNTAKLFNSTYNGTYISTNSINSTLNITLQCRIKQIINMWQGVGRAM
YAPPIAGNITCRSNITGLLLTRDGGIHNDSNVTETFRPAGGDMRDNWRSELYKYKVVEIQPLGIAPTGAK
ERVVERGKEAAGLGALFLGFLGAAGSTMGAASITLTVQARQLLSGIVQQQSNLLRAIEAQQHMLQLTVWG
IKQLQARVLALERYLKDQQLLGIWGCSGKLICTTNVPWNTSWSNKSEMDIWNNMTWMQWEREISNYTGTI
YKLLEDSQNQQERNEQDLLALDSWNSLWNWFDITKWLWYIKIFIMIVGGLIGLRIVFAVLSIVNRVRQGY
SPLSLQTLTPNPREPDRLRGIEEEGGEQDRDKSIRLVNGFLPIVWDDLRSLCLFSYHRLRDFLLLAARVV
ELLGRSSLRGLQRGWEVLKYLGSLVQYWGLELKKSAISLFDTLAVAVAEGTDRIIELIQGFCRAIRNIPR
RIRQGFEASLL

4. Truncate to gp120

>CH0848.3.d1651.10.07_CD5ss_Delta11 gp120
MPMGSLQPLATLYLLGMLVASCLGVPVWKEAKTTLFCASDAKAYVKEVHNVWATHACVPTDPSPQELVLD
NVTENFNMWKNDMVDQMHEDIISLWDQSLKPCVKLTPLCVTLNCSNAIVKNSTTEEISHALARNSTTEEM
KNCSFNTTTEIRDKEKKEYALFYRPDIVPLNNKTSNISEYRLINCNTSTVTQACPKVTFEPIPIHYCAPA
GYAILKCNDETFNGTGPCSNVSTVQCTHGIRPVVSTQLLLNGSLAEKGIVIRSENLTNNAKIIIVQLNAN
ASVEIVCTRPNNNTRKSVRIGPGQTFYATGDIIGNIRQAHCNISEKKWNETLQKVGIELQKHFPNKTIKY
NQSAGGDMEITTHSFNCGGEFFYCNTAKLFNSTYNGTYISTNSINSTLNITLQCRIKQIINMWQGVGRAM
YAPPIAGNITCRSNITGLLLTRDGGIHNDSNVTETFRPAGGDMRDNWRSELYKYKVVEIQPLGIAPTGAK
ERVVERGKE >CH0848.3.d1651.10.07_CD5ss_Delta11 gp120
ATGCCCATGGGCTCCCTGCAGCCCCTGGCCACCCTGTACCTGCTGGGCATGCTGGTGGCCTCCT
GCCTGGGCGTGCCCGTGTGGAAGGAGGCCAAGACCACCCTGTTCTGCGCCTCCGACGCCAAGGC
CTACGTGAAGGAGGTGCACAACGTGTGGGCCACCCACGCCTGCGTGCCCACCGACCCCTCCCCC
CAGGAGCTGGTGCTGGACAACGTGACCGAGAACTTCAACATGTGGAAGAACGACATGGTGGACC
AGATGCACGAGGACATCATCTCCCTGTGGGACCAGTCCCTGAAGCCCTGCGTGAAGCTGACCCC
CCTGTGCGTGACCCTGAACTGCTCCAACGCCATCGTGAAGAACTCCACCACCGAGGAGATCTCC
CACGCCCTGGCCCGCAACTCCACCACCGAGGAGATGAAGAACTGCTCCTTCAACACCACCACCG
AGATCCGCGACAAGGAGAAGAAGGAGTACGCCCTGTTCTACCGCCCCGACATCGTGCCCCTGAA
CAACAAGACCTCCAACATCTCCGAGTACCGCCTGATCAACTGCAACACCTCCACCGTGACCCAG
GCCTGCCCCAAGGTGACCTTCGAGCCCATCCCCATCCACTACTGCGCCCCCGCCGGCTACGCCA
TCCTGAAGTGCAACGACGAGACCTTCAACGGCACCGGCCCCTGCTCCAACGTGTCCACCGTGCA
GTGCACCCACGGCATCCGCCCCGTGGTGTCCACCCAGCTGCTGCTGAACGGCTCCCTGGCCGAG
AAGGGCATCGTGATCCGCTCCGAGAACCTGACCAACAACGCCAAGATCATCATCGTGCAGCTGA
ACGCCAACGCCTCCGTGGAGATCGTGTGCACCCGCCCCAACAACAACACCCGCAAGTCCGTGCG
CATCGGCCCCGGCCAGACCTTCTACGCCACCGGCGACATCATCGGCAACATCCGCCAGGCCCAC
TGCAACATCTCCGAGAAGAAGTGGAACGAGACCCTGCAGAAGGTGGGCATCGAGCTGCAGAAGC
ACTTCCCCAACAAGACCATCAAGTACAACCAGTCCGCCGGCGGCGACATGGAGATCACCACCCA
CTCCTTCAACTGCGGCGGCGAGTTCTTCTACTGCAACACCGCCAAGCTGTTCAACTCCACCTAC
AACGGCACCTACATCTCCACCAACTCCATCAACTCCACCCTGAACATCACCCTGCAGTGCCGCA
TCAAGCAGATCATCAACATGTGGCAGGGCGTGGGCCGCGCCATGTACGCCCCCCCCATCGCCGG
CAACATCACCTGCCGCTCCAACATCACCGGCCTGCTGCTGACCCGCGACGGCGGCATCCACAAC
GACTCCAACGTGACCGAGACCTTCCGCCCCGCCGGCGGCGACATGCGCGACAACTGGCGCTCCG

Figure 44C continued

AGCTGTACAAGTACAAGGTGGTGGAGATCCAGCCCCTGGGCATCGCCCCCACCGGCGCCAAGGA
GCGCGTGGTGGAGCGCGGCAAGGAG

Figure 44D

>703010848.3.d0949.10.17_signature_opt_b_T250.4_V1V2
TRVMGILKNYPQWWIWGILGFWMLMICNGKGKLWVTVYYGVPVWKEAKTTLFCASDARAYEKEVHNVWAT
HACVPTDPSPQELVLGNVTENFNMWKNDMVDQMHEDIISLWDQSLKPCVKLTPLCVTLICQAFNSSSHTN
SSIAMQEMKNCSFNVTTELRDKKKKEYSFFYKTDIEQINKNGRQYRLINCNTSAITQDTSAVTQACPKVT
FEPIPIHYCAPAGYAILKCNNETFNGTGPCTNVSTVQCTHGIRPVVSTQLLLNGSLAEKEIVIRSENLTN
NAKIIIVHLKTPVEINCTRPNNNTRKSIRIGPGQTFYATGDIIGDIKQAHCNISEAKWNDTLQNVSIELQ
KHFPNKTIKYNQSAGGDMEITTHSFNCGGEFFYCDTSNLFNGTYNGTYISTNSSANSTSTITLQCRIKQI
INMWQGVGRAMYAPPIAGNITCRSSITGLLLTRDGGTNSNETETFRPAGGDMRDNWRSELYKYKVVEIQP
LGIAPTGAKRRVVEREKRAAGLGALFLGFLGAAGSTMGAASITLTVQARQLLSGIVQQQSNLLRAIEAQQ
HMLQLTVWGIKQLQARVLAIERYLKDQQLLGMWGCSGKLICTTNVPWNASWSNKSETDIWDNMTWMQWER
EISNYTETIYKLLEDSQNQQERNEQDLLALDSWNSLWNWFNITKWLWYIKIFIMIVGGLIGLRIVFAVLS
IVNRVRQGYSPLSLQTLTPNPREPDRLRGIEEEGGEQDRDRSGRLVHGFLPIVWDDLRSLCLFSYHQLRD
LLLLAARVVELLGRSSLRGLQRGWEVLKYLGSLVQYWGLELKKSAISLFDTLAIAVAEGTDRIIELIQRI
CRAIRNIPTRIRQGFEASLL

1. Replace signal peptide with CD5
>703010848.3.d0949.10.17_signature_opt_b_T250.4_V1V2_CD5ss
MPMGSLQPLATLYLLGMLVASCLGKGKLWVTVYYGVPVWKEAKTTLFCASDARAYEKEVHNVWATHACVP
TDPSPQELVLGNVTENFNMWKNDMVDQMHEDIISLWDQSLKPCVKLTPLCVTLICQAFNSSSHTNSSIAM
QEMKNCSFNVTTELRDKKKKEYSFFYKTDIEQINKNGRQYRLINCNTSAITQDTSAVTQACPKVTFEPIP
IHYCAPAGYAILKCNNETFNGTGPCTNVSTVQCTHGIRPVVSTQLLLNGSLAEKEIVIRSENLTNNAKII
IVHLKTPVEINCTRPNNNTRKSIRIGPGQTFYATGDIIGDIKQAHCNISEAKWNDTLQNVSIELQKHFPN
KTIKYNQSAGGDMEITTHSFNCGGEFFYCDTSNLFNGTYNGTYISTNSSANSTSTITLQCRIKQIINMWQ
GVGRAMYAPPIAGNITCRSSITGLLLTRDGGTNSNETETFRPAGGDMRDNWRSELYKYKVVEIQPLGIAP
TGAKRRVVEREKRAAGLGALFLGFLGAAGSTMGAASITLTVQARQLLSGIVQQQSNLLRAIEAQQHMLQL
TVWGIKQLQARVLAIERYLKDQQLLGMWGCSGKLICTTNVPWNASWSNKSETDIWDNMTWMQWEREISNY
TETIYKLLEDSQNQQERNEQDLLALDSWNSLWNWFNITKWLWYIKIFIMIVGGLIGLRIVFAVLSIVNRV
RQGYSPLSLQTLTPNPREPDRLRGIEEEGGEQDRDRSGRLVHGFLPIVWDDLRSLCLFSYHQLRDLLLLA
ARVVELLGRSSLRGLQRGWEVLKYLGSLVQYWGLELKKSAISLFDTLAIAVAEGTDRIIELIQRICRAIR
NIPTRIRQGFEASLL

2. Delete N-terminal residues
>703010848.3.d0949.10.17_signature_opt_b_T250.4_V1V2_CD5ss_Delta11
MPMGSLQPLATLYLLGMLVASCLGVPVWKEAKTTLFCASDARAYEKEVHNVWATHACVPTDPSPQELVLG
NVTENFNMWKNDMVDQMHEDIISLWDQSLKPCVKLTPLCVTLICQAFNSSSHTNSSIAMQEMKNCSFNVT
TELRDKKKKEYSFFYKTDIEQINKNGRQYRLINCNTSAITQDTSAVTQACPKVTFEPIPIHYCAPAGYAI
LKCNNETFNGTGPCTNVSTVQCTHGIRPVVSTQLLLNGSLAEKEIVIRSENLTNNAKIIIVHLKTPVEIN
CTRPNNNTRKSIRIGPGQTFYATGDIIGDIKQAHCNISEAKWNDTLQNVSIELQKHFPNKTIKYNQSAGG
DMEITTHSFNCGGEFFYCDTSNLFNGTYNGTYISTNSSANSTSTITLQCRIKQIINMWQGVGRAMYAPPI
AGNITCRSSITGLLLTRDGGTNSNETETFRPAGGDMRDNWRSELYKYKVVEIQPLGIAPTGAKRRVVERE
KRAAGLGALFLGFLGAAGSTMGAASITLTVQARQLLSGIVQQQSNLLRAIEAQQHMLQLTVWGIKQLQAR
VLAIERYLKDQQLLGMWGCSGKLICTTNVPWNASWSNKSETDIWDNMTWMQWEREISNYTETIYKLLEDS
QNQQERNEQDLLALDSWNSLWNWFNITKWLWYIKIFIMIVGGLIGLRIVFAVLSIVNRVRQGYSPLSLQT
LTPNPREPDRLRGIEEEGGEQDRDRSGRLVHGFLPIVWDDLRSLCLFSYHQLRDLLLLAARVVELLGRSS
LRGLQRGWEVLKYLGSLVQYWGLELKKSAISLFDTLAIAVAEGTDRIIELIQRICRAIRNIPTRIRQGFE
ASLL

3. Mutate furin site
>703010848.3.d0949.10.17_signature_opt_b_T250.4_V1V2_CD5ss_Delta11
gp160C
MPMGSLQPLATLYLLGMLVASCLGVPVWKEAKTTLFCASDARAYEKEVHNVWATHACVPTDPSPQELVLG

Figure 44D continued

NVTENFNMWKNDMVDQMHEDIISLWDQSLKPCVKLTPLCVTLICQAFNSSSHTNSSIAMQEMKNCSFNVT
TELRDKKKKEYSFFYKTDIEQINKNGRQYRLINCNTSAITQDTSAVTQACPKVTFEPIPIHYCAPAGYAI
LKCNNETFNGTGPCTNVSTVQCTHGIRPVVSTQLLLNGSLAEKEIVIRSENLTNNAKIIIVHLKTPVEIN
CTRPNNNTRKSIRIGPGQTFYATGDIIGDIKQAHCNISEAKWNDTLQNVSIELQKHFPNKTIKYNQSAGG
DMEITTHSFNCGGEFFYCDTSNLFNGTYNGTYISTNSSANSTSTITLQCRIKQIINMWQGVGRAMYAPPI
AGNITCRSSITGLLLTRDGGTNSNETETFRPAGGDMRDNWRSELYKYKVVEIQPLGIAPTGAKERVVERE
KEAAGLGALFLGFLGAAGSTMGAASITLTVQARQLLSGIVQQQSNLLRAIEAQQHMLQLTVWGIKQLQAR
VLAIERYLKDQQLLGMWGCSGKLICTTNVPWNASWSNKSETDIWDNMTWMQWEREISNYTETIYKLLEDS
QNQQERNEQDLLALDSWNSLWNWFNITKWLWYIKIFIMIVGGLIGLRIVFAVLSIVNRVRQGYSPLSLQT
LTPNPREPDRLRGIEEEGGEQDRDRSGRLVHGFLPIVWDDLRSLCLFSYHQLRDLLLLAARVVELLGRSS
LRGLQRGWEVLKYLGSLVQYWGLELKKSAISLFDTLAIAVAEGTDRIIELIQRICRAIRNIPTRIRQGFE
ASLL

4. Truncate to gp120

>703010848.3.d0949.10.17_signature_opt_b_T250.4_V1V2_CD5ss_Delta11
gp120
MPMGSLQPLATLYLLGMLVASCLGVPVWKEAKTTLFCASDARAYEKEVHNVWATHACVPTDPSPQELVLG
NVTENFNMWKNDMVDQMHEDIISLWDQSLKPCVKLTPLCVTLICQAFNSSSHTNSSIAMQEMKNCSFNVT
TELRDKKKKEYSFFYKTDIEQINKNGRQYRLINCNTSAITQDTSAVTQACPKVTFEPIPIHYCAPAGYAI
LKCNNETFNGTGPCTNVSTVQCTHGIRPVVSTQLLLNGSLAEKEIVIRSENLTNNAKIIIVHLKTPVEIN
CTRPNNNTRKSIRIGPGQTFYATGDIIGDIKQAHCNISEAKWNDTLQNVSIELQKHFPNKTIKYNQSAGG
DMEITTHSFNCGGEFFYCDTSNLFNGTYNGTYISTNSSANSTSTITLQCRIKQIINMWQGVGRAMYAPPI
AGNITCRSSITGLLLTRDGGTNSNETETFRPAGGDMRDNWRSELYKYKVVEIQPLGIAPTGAKERVVERE
KE

5. Codon optimize sequence

>703010848.3.d0949.10.17_signature_opt_b_T250.4_V1V2_CD5ss_Delta11
gp120
ATGCCCATGGGCTCCCTGCAGCCCCTGGCCACCCTGTACCTGCTGGGCATGCTGGTGGCCTCCT
GCCTGGGCGTGCCCGTGTGGAAGGAGGCCAAGACCACCCTGTTCTGCGCCTCCGACGCCCGCGC
CTACGAGAAGGAGGTGCACAACGTGTGGGCCACCCACGCCTGCGTGCCCACCGACCCCTCCCCC
CAGGAGCTGGTGCTGGGCAACGTGACCGAGAACTTCAACATGTGGAAGAACGACATGGTGGACC
AGATGCACGAGGACATCATCTCCCTGTGGGACCAGTCCCTGAAGCCCTGCGTGAAGCTGACCCC
CCTGTGCGTGACCCTGATCTGCCAGGCCTTCAACTCCTCCTCCCACACCAACTCCTCCATCGCC
ATGCAGGAGATGAAGAACTGCTCCTTCAACGTGACCACCGAGCTGCGCGACAAGAAGAAGAAGG
AGTACTCCTTCTTCTACAAGACCGACATCGAGCAGATCAACAAGAACGGCCGCCAGTACCGCCT
GATCAACTGCAACACCTCCGCCATCACCCAGGACACCTCCGCCGTGACCCAGGCCTGCCCCAAG
GTGACCTTCGAGCCCATCCCCATCCACTACTGCGCCCCCGCCGGCTACGCCATCCTGAAGTGCA
ACAACGAGACCTTCAACGGCACCGGCCCCTGCACCAACGTGTCCACCGTGCAGTGCACCCACGG
CATCCGCCCCGTGGTGTCCACCCAGCTGCTGCTGAACGGCTCCCTGGCCGAGAAGGAGATCGTG
ATCCGCTCCGAGAACCTGACCAACAACGCCAAGATCATCATCGTGCACCTGAAGACCCCCGTGG
AGATCAACTGCACCCGCCCCAACAACAACACCCGCAAGTCCATCCGCATCGGCCCCGGCCAGAC
CTTCTACGCCACCGGCGACATCATCGGCGACATCAAGCAGGCCCACTGCAACATCTCCGAGGCC
AAGTGGAACGACACCCTGCAGAACGTGTCCATCGAGCTGCAGAAGCACTTCCCCAACAAGACCA
TCAAGTACAACCAGTCCGCCGGCGGCGACATGGAGATCACCACCCACTCCTTCAACTGCGGCGG
CGAGTTCTTCTACTGCGACACCTCCAACCTGTTCAACGGCACCTACAACGGCACCTACATCTCC
ACCAACTCCTCCGCCAACTCCACCTCCACCATCACCCTGCAGTGCCGCATCAAGCAGATCATCA
ACATGTGGCAGGGCGTGGGCCGCGCCATGTACGCCCCCCCCATCGCCGGCAACATCACCTGCCG
CTCCTCCATCACCGGCCTGCTGCTGACCCGCGACGGCGGCACCAACTCCAACGAGACCGAGACC
TTCCGCCCCGCCGGCGGCGACATGCGCGACAACTGGCGCTCCGAGCTGTACAAGTACAAGGTGG

Figure 44D continued

TGGAGATCCAGCCCCTGGGCATCGCCCCCACCGGCGCCAAGGAGCGCGTGGTGGAGCGCGAGAA
GGAG

Figure 45

>AG.T250-4 Delta10 gp120

MPMGSLQPLATLYLLGMLVASVLAVPVWREADTTLFCASDAKGYDTEAHNVWATHACVPTDPRPQEMYLENVTENFNMW
KNSMVEQMHTDIISLWDESLKPCVKLTPLCVTLDCQAFNSSSHTNSSIAMQEMKNCSFNVTTELRDKKKKEYSFFYKTDIEQINK
NGRQYRLINCNTSAITQACPKVSFEPIPIHFCAPAGFAILKCNEKHFNGKGPCKNVSTVQCTHGIKPVVSTQLLLNGSLAEEEVVIR
VENTIDNAKTIIVQLAKPVKINCTRPNNNTRKSIRIGPGQTFYATGDIIGNIRKAYCNVSKREWNNTLQQVAAQLSKSFNNTKIVF
EKHSGGDLEVITHSFVCGGEFFYCNTSGLFNSTWHNSTWTNSTTGSNGTESNDTITLQCEIKQFINMWQRVGRAMYAPPIPG
VIRCESDITGLLLTRDGPNSTQNETFRPGGGDMRDNWRSELYKYKVVQIEPLGVAPTHAKERVVEREKE*

>T250-4chim.6R.SOSIP.664v4.1

MPMGSLQPLATLYLLGMLVASVLAAENLWVTVYYGVPVWREADTTLFCASDAKGYDTEAHNVWATHACVPTDPRPQEMYL
ENVTENFNMWKNSMVEQMHTDIISLWDESLKPCVKLTPLCVTLDCQAFNSSSHTNSSIAMQEMKNCSFNVTTELRDKKKKEY
SFFYKTDIEQINKNGRQYRLINCNTSAITQACPKVSFEPIPIHFCAPAGFAILKCNEKHFNGKGPCKNVSTVQCTHGIKPVVSTQLL
LNGSLAEEEVVIRVENTIDNAKTIIVQLAKPVKINCTRPNNNTRKSIRIGPGQTFYATGDIIGNIRKAYCNVSKREWNNTLQQVAA
QLSKSFNNTKIVFEKHSGGDLEVITHSFVCGGEFFYCNTSGLFNSTWHNSTWTNSTTGSNGTESNDTITLQCEIKQFINMWQRV
GRAMYAPPIPGVIRCESDITGLLLTRDGPNSTQNETFRPGGGDMRDNWRSELYKYKVVKIEPLGVAPTRCKRRVVGRRRRRRA
VGIGAVFLGFLGAAGSTMGAASMTLTVQARNLLSGIVQQQSNLLRAPEAQQHLLKLTVWGIKQLQARVLAVERYLRDQQLLGI
WGCSGKLICCTNVPWNSSWSNRNLSEIWDNMTWLQWDKEISNYTQIIYGLLEESQNQQEKNEQDLLALD*

>BG505 SOSIP MUT11B

MPMGSLQPLATLYLLGMLVASVLAAENLWVTVYYGVPVWKDAETTLFCASDAKAYETEKHNVWATHACVPTDPNPQEIHLE
NVTEEFNMWKNNMVEQMHEDIISLWDQSLKPCVKLTPLCVTLQCTNYAPNLLSNMRGELKNCSFNMTTELRDKKQKVYSLF
YRLDVVQINENQGNRSNNSNKEYRLINCNTSAITQACPKVSFEPIPIHYCAPAGFAILKCKDKKFNGTGPCPSVSTVQCTHGIKPV
VSTQLLLNGSLAEEEVIIRSENITNNAKNILVQLNTPVQINCTRPNNNTVKSIRIGPGQAFYYFGDIIGDIRMAHCNVSKATWNET
LGKVVKQLRKHFGNNTIIRFAQSSGGDLEVTTHSFNCGGEFFYCNTSGLFNSTWISNTSVQGSNSTGSNDSIVLPCRIKQIINMW
QRIGQAMYAPPIQGVIRCVSNITGLILTRDGGSTNSTTETFRPGGGDMRDNWRSELYKYKVVKIEPLGVAPTRCKRRVVGRRRR
RRAVGIGAVSLGFLGAAGSTMGAASMTLTVQARNLLSGIVQQQSNLLRAPEPQQHLLKDTHWGIKQLQARVLAVEHYLRDQ
QLLGIWGCSGKLICCTNVPWNSSWSNRNLSEIWDNMTWLQWDKEISNYTQIIYGLLEESQNQQEKNEQDLLALDGGGSGS*

>CH0848.3.D0949.10.17gp140c

MRVMGILKNYPQWWIWGILGFWMLMICNGKGKLWVTVYYGVPVWKEAKTTLFCASDARAYEKEVHNVWATHACVPTDP
SPQELVLGNVTENFNMWKNDMVDQMHEDIISLWDQSLKPCVKLTPLCVTLICSNATVKNGTVEEMKNCSFNTTTEIRDKEKK
EYALFYKPDIVPLSETNNTSEYRLINCNTSAVTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFYATGDIIGDIKQAHCNISEEKWNDTLQK
VGIELQKHFPNKTIKYNQSAGGDMEITTHSFNCGGEFFYCNTSNLFNGTYNGTYISTNSSANSTSTITLQCRIKQIINMWQGVGR
AMYAPPIAGNITCRSNITGLLLTRDGGTNSNETETFRPAGGDMRDNWRSELYKYKVVEIQPLGIAPTGAKERVVEREKEAAGLG
ALFLGFLGAAGSTMGAASITLTVQARQLLSGIVQQQSNLLRAIEAQQHMLQLTVWGIKQLQARVLALERYLKDQQLLGMWGC

Figure 45 continued

SGKLICTTNVPWNTSWSNKSETDIWDNMTWMQWEREISNYTETIYKLLEDSQNQQERNEQDLLALDSWNSLWNWFSITKW
LWYIK*

>CH0848.3.D0836.10.31gp140C

MRVMGILKNYPQWWIWGILGFWMLMICNGEGNLWVTVYYGVPVWKEAKTTLFCASDAKAYKKEVHNVWATHACVPTDP
SPQELFLKNVTENFNMWKNDMVDQMHEDIISLWDQSLKPCVKLTPLCVTLICSNATVKNSTVEEMKNCSFNTTTEIRDKEKKE
YALFYRPDIVPLNNETSNTSEYRLINCNTSAVTQACPKVTFEPIPIHYCAPAGYAILKCNDETFNGTGPCSNVSTVQCTHGIRPVVS
TQLLLNGSLAEKGIVIRSENLTNNAKIIIVHLHTPVEIVCTRPNNNTRKSVRIGPGQTFYATGDIIGDIRQAHCNISESKWNETLQK
VGKELQKHFPNKTIKYAQSAGGDMEITTHSFNCGGEFFYCNTAKLFNGTYNGTDISTNSSTNSNPTITLQCRIKQIINMWQGVG
RAMYAPPIAGNITCKSNITGLLLTRDGGTNSSGKEEIFRPAGGDMRDNWRSELYKYKVVEIQPLGIAPTGAKERVVEREKEAAGL
GALFLGFLGAAGSTMGAASITLTVQARQLLSGIVQQQSNLLRAIEAQQHMLQLTVWGIKQLQARVLALERYLKDQQLLGMWG
CSGKLICTTNVPWNTSWSNKSETDIWDNMTWMQWEREISNYTETIYKLLEDSQNQQERNEQDLLALDSWNSLWNWFNITK
WLWYIK*

>CH848.3.D0949.10.17_GT1_D11gp120
MPMGSLQPLATLYLLGMLVASVLAVPVWKEAKTTLFCASDARAYEKKVHNVWATHACVPTDPSPQELVLGNVTENFNMWK
NDMVDQMHEDIISLWDQSLKPCVKLTPLCVTLICSNYAPKNLLVEEMKNCSFNTTTEIRDKEKKEYALFYKPDIVPLSETNNTSEY
RLINCNTSAVTQACPKVTFEPIPIHYCAPAGYAILKCNDETFNGTGPCSNVSTVQCTHGIRPVVSTQLLLNGSLAEKEIIIRSENLTN
NAKIIIVHLHTPVEIVCTRPNNNTVKSVRIGPGQWFYYFGDIIGDIKMAHCNISEEKWNDTLQKVGIELQKHFPNKTIKYNQSAG
GDMEITTHSFNCGGEFFYCNTSNLFNGTYNGTYISTNSSANSTSTIVLQCRIKQIINMWQGVGRAMYAPPIAGNITCRSNITGLL
LTRDGGTNSNETETFRPAGGDMRDNWRSELYKYKVVEIQPLGIAPTGAKERVVEREKEGS*

>BG505_MUT11B_ D11gp120

MPMGSLQPLATLYLLGMLVASVLAAENLWVTVYYGVPVWKDAETTLFCASDAKAYETEKHNVWATHACVPTDPNPQEIHLE
NVTEEFNMWKNNMVEQMHEDIISLWDQSLKPCVKLTPLCVTLQCTNYAPNLLSNMRGELKNCSFNMTTELRDKKQKVYSLF
YRLDVVQINENQGNRSNNSNKEYRLINCNTSAITQACPKVSFEPIPIHYCAPAGFAILKCKDKKFNGTGPCPSVSTVQCTHGIKPV
VSTQLLLNGSLAEEEVIIRSENITNNAKNILVQLNTPVQINCTRPNNNTVKSIRIGPGQAFYYFGDIIGDIRMAHCNVSKATWNET
LGKVVKQLRKHFGNNTIIRFAQSSGGDLEVTTHSFNCGGEFFYCNTSGLFNSTWISNTSVQGSNSTGSNDSIVLPCRIKQIINMW
QRIGQAMYAPPIQGVIRCVSNITGLILTRDGGSTNSTTETFRPGGGDMRDNWRSELYKYKVVKIEPLGVAPTRCKERVVGREKE
GS*

>B.JRFLgp140CF_V1_3Q

MPMGSLQPLATLYLLGMLVASVLAVEKLWVTVYYGVPVWKEATTTLFCASDAKAYDTEVHNVWATHACVPTDPNPQEVVLE
NVTEHFNMWKNNMVEQMQEDIISLWDQSLKPCVKLTPLCVTLNCKDVQATQTTQDSEGTMERGEIKNCSFNITTSIRDEVQK
EYALFYKLDVVPIDNNNTSYRLISCDTSVITQACPKISFEPIPIHYCAPAGFAILKCNDKTFNGKGPCKNVSTVQCTHGIRPVVSTQL
LLNGSLAEEEVVIRSDNFTNNAKTIIVQLKESVEINCTRPNNNTRKSIHIGPGRAFYTTGEIIGDIRQAHCNISRAKWNDTLKQIVIK

Figure 45 continued

LREQFENKTIVFNHSSGGDPEIVMHSFNCGGEFFYCNSTQLFNSTWNNNTEGSNNTEGNTITLPCRIKQIINMWQEVGKAMY
APPIRGQIRCSSNITGLLLTRDGGINENGTEIFRPGGGDMRDNWRSELYKYKVVKIEPLGVAPTKAKTLTVQARLLLSGIVQQQN
NLLRAIEAQQRMLQLTVWGIKQLQARVLAVERYLGDQQLLGIWGCSGKLICTTAVPWNASWSNKSLDRIWNNMTWMEWE
REIDNYTSEIYTLIEESQNQQEKNEQELLELDKWASLWNWFDITKWLW*

>CON-Sgp140CFI_V1_4Q

MRVRGIQRNCQHLWRWGTLILGMLMICSAAENLWVTVYYGVPVWKEANTTLFCASDAKAYDTEVHNVWATHACVPTDPN
PQEIVLENVTENFNMWKNNMVEQMHEDIISLWDQSLKPCVKLTPLCVTLQCTNVQVTQTTQNTEEKGEIKNCSFNITTEIRDK
KQKVYALFYRLDVVPIDDNNNNSSNYRLINCNTSAITQACPKVSFEPIPIHYCAPAGFAILKCNDKKFNGTGPCKNVSTVQCTHGI
KPVVSTQLLLNGSLAEEEIIIRSENITNNAKTIIVQLNESVEINCTRPNNNTRKSIRIGPGQAFYATGDIIGDIRQAHCNISGTKWNK
TLQQVAKKLREHFNNKTIIFKPSSGGDLEITTHSFNCRGEFFYCNTSGLFNSTWIGNGTKNNNNTNDTITLPCRIKQIINMWQGV
GQAMYAPPIEGKITCKSNITGLLLTRDGGNNNTNETEIFRPGGGDMRDNWRSELYKYKVVKIEPLGVAPTKAKLTVQARQLLSG
IVQQQSNLLRAIEAQQHLLQLTVWGIKQLQARVLAVERYLKDQQLEIWDNMTWMEWEREINNYTDIIYSLIEESQNQQEKNE
QELLALDKWASLWNWFDITNWLW*

> CH848.3.D0949.10.17CHIM.6R.SOSIP.664V4.1

MPMGSLQPLATLYLLGMLVASVLAAENLWVTVYYGVPVWKEAKTTLFCASDARAYEKKVHNVWATHACVPTDPSPQELVLG
NVTENFNMWKNDMVDQMHEDIISLWDQSLKPCVKLTPLCVTLICSNATVKNGTVEEMKNCSFNTTTEIRDKEKKEYALFYKPD
IVPLSETNNTSEYRLINCNTSAVTQACPKVTFEPIPIHYCAPAGYAILKCNDETFNGTGPCSNVSTVQCTHGIRPVVSTQLLLNGSL
AEKEIVIRSENLTNNAKIIIVHLHTPVEIVCTRPNNNTRKSVRIGPGQWFYATGDIIGDIKQAHCNISEEKWNDTLQKVGIELQKHF
PNKTIKYNQSAGGDMEITTHSFNCGGEFFYCNTSNLFNGTYNGTYISTNSSANSTSTITLQCRIKQIINMWQGVGRAMYAPPIA
GNITCRSNITGLLLTRDGGTNSNETETFRPAGGDMRDNWRSELYKYKVVKIEPLGVAPTRCKRRVVGRRRRRRAVGIGAVFLGF
LGAAGSTMGAASMTLTVQARNLLSGIVQQQSNLLRAPEAQQHLLKLTVWGIKQLQARVLAVERYLRDQQLLGIWGCSGKLIC
CTNVPWNSSWSNRNLSEIWDNMTWLQWDKEISNYTQIIYGLLEESQNQQEKNEQDLLALD*

> CH0848.3.D0836.10.31CHIM.6R.SOSIP.664V4.1

MPMGSLQPLATLYLLGMLVASVLAAENLWVTVYYGVPVWKEAKTTLFCASDAKAYKKKVHNVWATHACVPTDPSPQELFLK
NVTENFNMWKNDMVDQMHEDIISLWDQSLKPCVKLTPLCVTLICSNATVKNSTVEEMKNCSFNTTTEIRDKEKKEYALFYRPD
IVPLNNETSNTSEYRLINCNTSAVTQACPKVTFEPIPIHYCAPAGYAILKCNDETFNGTGPCSNVSTVQCTHGIRPVVSTQLLLNGS
LAEKGIVIRSENLTNNAKIIIVHLHTPVEIVCTRPNNNTRKSVRIGPGQWFYATGDIIGDIRQAHCNISESKWNETLQKVGKELQK
HFPNKTIKYAQSAGGDMEITTHSFNCGGEFFYCNTAKLFNGTYNGTDISTNSSTNSNPTITLQCRIKQIINMWQGVGRAMYAP
PIAGNITCKSNITGLLLTRDGGTNSSGKEEIFRPAGGDMRDNWRSELYKYKVVKIEPLGVAPTRCKRRVVGRRRRRRAVGIGAVF
LGFLGAAGSTMGAASMTLTVQARNLLSGIVQQQSNLLRAPEAQQHLLKLTVWGIKQLQARVLAVERYLRDQQLLGIWGCSGK
LICCTNVPWNSSWSNRNLSEIWDNMTWLQWDKEISNYTQIIYGLLEESQNQQEKNEQDLLALD*

> CH0848.3.D0358.80.06CHIM.6R.SOSIP.664V4.1

Figure 45 continued

MPMGSLQPLATLYLLGMLVASVLAAENLWVTVYYGVPVWKEAKTTLFCASDAKAYEKKVHNVWATHACVPTDPSPQELVLK
NVTENFNMWKNDMVDQMHEDIISLWDQSLKPCVKLTPLCVTLNCSNARSNVNVTSINNTIMGEMKNCSFNTTTEIRDKEKK
EYALFYKPDVVPLNETSNTSEYRLINCNTSAVTQACPKVTFEPIPIHYCAPAGYAILKCNNKTFNGTGPCSNVSTVQCTHGIRPVV
STQLLLNGSLAEKEIVIRSENLTNNAKIIIVHLNTSVEIVCTRPGNNTRKSVRIGPGQWFYATGDIIGDIRQAHCNISEGQWNKTLH
EVSKELQKHFPNKTIKYERSAGGDMEIATHSFNCGGEFFYCNTSNLFNGTYNGTYINTSSTSYITLQCRIKQIINMWQGVGRAM
YAPPIAGNITCKSNITGLLLTRDGGTKNNSNEETFRPAGGDMRDNWRSELYKYKVVKIEPLGVAPTRCKRRVVGRRRRRRAVGI
GAVFLGFLGAAGSTMGAASMTLTVQARNLLSGIVQQQSNLLRAPEAQQHLLKLTVWGIKQLQARVLAVERYLRDQQLLGIWG
CSGKLICCTNVPWNSSWSNRNLSEIWDNMTWLQWDKEISNYTQIIYGLLEESQNQQEKNEQDLLALD*

>CH848.3.D1432.5.41CHIM.6R.SOSIP.664V4.1

MPMGSLQPLATLYLLGMLVASVLAAENLWVTVYYGVPVWKEAKTTLFCASDAKAYKKKVHNVWATHACVPTDPSPQELFLK
NVTENFNMWKNDMVDQMHEDIISLWDQSLKPCVKLTPLCVTLICSNAIVKNSTTEEMSTALVKNSTTEAMKNCSFNTTTEIRD
KEKKEYALFYRPDIVPLNNETGNISEYRLINCNTSAVTQACPKVTFEPIPIHYCAPAGYAILKCNDETFNGTGPCSNVSTVQCTHGI
RPVVSTQLLLNGSLAKEEIVIRSENLTNNAKIIIVHLHTPVEIVCTRPNNNTRKSVRIGPGQWFYATGDIIGDPRKAHCNISEKDW
NKTLQEVGKELQKHFPNKTIRYNQSAGGDMEITTHSFNCGGEFFYCNTSKLFNSTYNDTYISTNSSANNSSTITLQCRIKQIINM
WQGVGRAMYAPPIAGNITCKSNITGLLLTRDGGPDSNETETFRPAGGDMRDNWRSELYKYKVVKIEPLGVAPTRCKRRVVGR
RRRRRAVGIGAVFLGFLGAAGSTMGAASMTLTVQARNLLSGIVQQQSNLLRAPEAQQHLLKLTVWGIKQLQARVLAVERYLR
DQQLLGIWGCSGKLICCTNVPWNSSWSNRNLSEIWDNMTWLQWDKEISNYTQIIYGLLEESQNQQEKNEQDLLALD*

>CH848.3.D0526.25.02CHIM.6R.SOSIP.664V4.1

MPMGSLQPLATLYLLGMLVASVLAAENLWVTVYYGVPVWKEAKTTLFCASDARAYEKKVHNVWATHACVPTDPSPQELFLE
NVTENFNMWKNDMVDQMHEDIISLWDQSLKPCVKLTPLCVTLICSNATVNNRTAYDTRSNVNVTSINNTIMGEMKNCSFNT
TTEIRDKEKKEYALFYKPDIVPLNETSNTSEYRLINCNTSAVTQACPKVTFEPIPIHYCAPAGYAILKCNNETFNGTGPCSNVSTVQ
CTHGIRPVVSTQLLLNGSLAEKEIVIRSENLTNNAKIIIVHLNTSVEIVCTRPGNNTRKSVRIGPGQWFYATGDIIGDIRQAHCNISE
KQWNETLQKVGKELQKHFPNKTIKYERSAGGDMEIATHSFNCGGEFFYCNTSKLFNGTYNGTDINISTNSNSTITLQCRIKQIIN
MWQGVGRAMYAPPIAGNITCKSNITGLLLTRDGGTNSNKTEETFRPAGGDMRDNWRSELYKYKVVKIEPLGVAPTRCKRRVV
GRRRRRRAVGIGAVFLGFLGAAGSTMGAASMTLTVQARNLLSGIVQQQSNLLRAPEAQQHLLKLTVWGIKQLQARVLAVERY
LRDQQLLGIWGCSGKLICCTNVPWNSSWSNRNLSEIWDNMTWLQWDKEISNYTQIIYGLLEESQNQQEKNEQDLLALD*

>CH848.3.D0949.10.17CHIM.6R.SOSIP.664V4.1_GT1

MPMGSLQPLATLYLLGMLVASVLAAENLWVTVYYGVPVWKEAKTTLFCASDARAYEKKVHNVWATHACVPTDPSPQELVLG
NVTENFNMWKNDMVDQMHEDIISLWDQSLKPCVKLTPLCVTLICSNYAPKNLLVEEMKNCSFNTTTEIRDKEKKEYALFYKPDI
VPLSETNNTSEYRLINCNTSAVTQACPKVTFEPIPIHYCAPAGYAILKCNDETFNGTGPCSNVSTVQCTHGIRPVVSTQLLLNGSL
AEKEIIIRSENLTNNAKIIIVHLHTPVEIVCTRPNNNTVKSVRIGPGQWFYYFGDIIGDIKMAHCNISEEKWNDTLQKVGIELQKHF
PNKTIKYNQSAGGDMEITTHSFNCGGEFFYCNTSNLFNGTYNGTYISTNSSANSTSTIVLQCRIKQIINMWQGVGRAMYAPPIA
GNITCRSNITGLLLTRDGGTNSNETETFRPAGGDMRDNWRSELYKYKVVKIEPLGVAPTRCKRRVVGRRRRRRAVGIGAVSLGF
LGAAGSTMGAASMTLTVQARNLLSGIVQQQSNLLRAPEPQQHLLKDTHWGIKQLQARVLAVEHYLRDQQLLGIWGCSGKLIC
CTNVPWNSSWSNRNLSEIWDNMTWLQWDKEISNYTQIIYGLLEESQNQQEKNEQDLLALD*

Figure 45 continued

> CH848.3.D0949.10.17chim.6R.DS.SOSIP.664_N332A

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATVKNGTVEEMKNCSFNTTTEIRDKEKKEYALFYKPDIVP
LSETNNTSEYRLINCNTSACTQACPKVTFEPIPIHYCAPAGYAILKCNDETFNGTGPCSNVSTVQCTHGIRPVVSTQLLLNGSLAEK
EIVIRSENLTNNAKIIIVHLHTPVEIVCTRPNNNTRKSVRIGPGQTFYATGDIIGDIKQAHCAISEEKWNDTLQKVGIELQKHFPNK
TIKYNQSAGGDMEITTHSFNCGGEFFYCNTSNLFNGTYNGTYISTNSSANSTSTITLQCRIKQIINMWQGVGRCMYAPPIAGNIT
CRSNITGLLLTRDGGTNSNETETFRPAGGDMRDNWRSELYKYKVVKIEPLGVAPTRCKRRVVGRRRRRRAVGIGAVFLGFLGAA
GSTMGAASMTLTVQARNLLSGIVQQQSNLLRAPEAQQHLLKLTVWGIKQLQARVLAVERYLRDQQLLGIWGCSGKLICCTNV
PWNSSWSNRNLSEIWDNMTWLQWDKEISNYTQIIYGLLEESQNQQEKNEQDLLALDGS*

>CH848.3.D0949.10.17chim.6R.DS.SOSIP.664_N301A

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATVKNGTVEEMKNCSFNTTTEIRDKEKKEYALFYKPDIVP
LSETNNTSEYRLINCNTSACTQACPKVTFEPIPIHYCAPAGYAILKCNDETFNGTGPCSNVSTVQCTHGIRPVVSTQLLLNGSLAEK
EIVIRSENLTNNAKIIIVHLHTPVEIVCTRPNANTRKSVRIGPGQTFYATGDIIGDIKQAHCNISEEKWNDTLQKVGIELQKHFPNK
TIKYNQSAGGDMEITTHSFNCGGEFFYCNTSNLFNGTYNGTYISTNSSANSTSTITLQCRIKQIINMWQGVGRCMYAPPIAGNIT
CRSNITGLLLTRDGGTNSNETETFRPAGGDMRDNWRSELYKYKVVKIEPLGVAPTRCKRRVVGRRRRRRAVGIGAVFLGFLGAA
GSTMGAASMTLTVQARNLLSGIVQQQSNLLRAPEAQQHLLKLTVWGIKQLQARVLAVERYLRDQQLLGIWGCSGKLICCTNV
PWNSSWSNRNLSEIWDNMTWLQWDKEISNYTQIIYGLLEESQNQQEKNEQDLLALDGS*

> CH848.3.D0949.10.17chim.6R.DS.SOSIP.664

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATVKNGTVEEMKNCSFNTTTEIRDKEKKEYALFYKPDIVP
LSETNNTSEYRLINCNTSACTQACPKVTFEPIPIHYCAPAGYAILKCNDETFNGTGPCSNVSTVQCTHGIRPVVSTQLLLNGSLAEK
EIVIRSENLTNNAKIIIVHLHTPVEIVCTRPNNNTRKSVRIGPGQTFYATGDIIGDIKQAHCNISEEKWNDTLQKVGIELQKHFPNK
TIKYNQSAGGDMEITTHSFNCGGEFFYCNTSNLFNGTYNGTYISTNSSANSTSTITLQCRIKQIINMWQGVGRCMYAPPIAGNIT
CRSNITGLLLTRDGGTNSNETETFRPAGGDMRDNWRSELYKYKVVKIEPLGVAPTRCKRRVVGRRRRRRAVGIGAVFLGFLGAA
GSTMGAASMTLTVQARNLLSGIVQQQSNLLRAPEAQQHLLKLTVWGIKQLQARVLAVERYLRDQQLLGIWGCSGKLICCTNV
PWNSSWSNRNLSEIWDNMTWLQWDKEISNYTQIIYGLLEESQNQQEKNEQDLLALDGS*

> B.JRFL gp120core_mini-V3_v2

MDAMKRGLCCVLLLCGAVFVSPSASMRHHHHHHVTEHFNMWKNNMVEQMQEDIISLWDQSLKPCVKLTPLCVGSGSCDT
SVITQACPKISFEPIPIHYCAPAGFAILKCNDKTFNGKGPCKNVSTVQCTHGIRPVVSTQLLLNGSLAEEEVVIRSDNFTNNAKTIIV
QLKESVEINCTRPNNNTRPGEIIGDIRQAHCNISRAKWNDTLKQIVIKLREQFENKTIVFNHSSGGDPEIVMHSFNCGGEFFYCN

Figure 45 continued

STQLFNSTWNNNTEGSNNTEGNTITLPCRIKQIINMWQEVGKAMYAPPIRGQIRCSSNITGLLLTRDGGINENGTEIFRPGGGD
MRDNWRSELYKYKVVKIE*

>CH848.3.D0949.10.17chim.6R.DS.SOSIP.664

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATVKNGTVEEMKNCSFNTTTEIRDKEKKEYALFYKPDIVP
LSETNNTSEYRLINCNTSACTQACPKVTFEPIPIHYCAPAGYAILKCNDETFNGTGPCSNVSTVQCTHGIRPVVSTQLLLNGSLAEK
EIVIRSENLTNNAKIIIVHLHTPVEIVCTRPNNNTRKSVRIGPGQTFYATGDIIGDIKQAHCNISEEKWNDTLQKVGIELQKHFPNK
TIKYNQSAGGDMEITTHSFNCGGEFFYCNTSNLFNGTYNGTYISTNSSANSTSTITLQCRIKQIINMWQGVGRCMYAPPIAGNIT
CRSNITGLLLTRDGGTNSNETETFRPAGGDMRDNWRSELYKYKVVKIEPLGVAPTRCKRRVVGRRRRRRAVGIGAVFLGFLGAA
GSTMGAASMTLTVQARNLLSGIVQQQSNLLRAPEAQQHLLKLTVWGIKQLQARVLAVERYLRDQQLLGIWGCSGKLICCTNV
PWNSSWSNRNLSEIWDNMTWLQWDKEISNYTQIIYGLLEESQNQQEKNEQDLLALD*

>CH848.3.D0949.10.17chim.6R.DS.SOSIP.664_N301AN332A

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATVKNGTVEEMKNCSFNTTTEIRDKEKKEYALFYKPDIVP
LSETNNTSEYRLINCNTSACTQACPKVTFEPIPIHYCAPAGYAILKCNDETFNGTGPCSNVSTVQCTHGIRPVVSTQLLLNGSLAEK
EIVIRSENLTNNAKIIIVHLHTPVEIVCTRPNANTRKSVRIGPGQTFYATGDIIGDIKQAHCAISEEKWNDTLQKVGIELQKHFPNKT
IKYNQSAGGDMEITTHSFNCGGEFFYCNTSNLFNGTYNGTYISTNSSANSTSTITLQCRIKQIINMWQGVGRCMYAPPIAGNITC
RSNITGLLLTRDGGTNSNETETFRPAGGDMRDNWRSELYKYKVVKIEPLGVAPTRCKRRVVGRRRRRRAVGIGAVFLGFLGAA
GSTMGAASMTLTVQARNLLSGIVQQQSNLLRAPEAQQHLLKLTVWGIKQLQARVLAVERYLRDQQLLGIWGCSGKLICCTNV
PWNSSWSNRNLSEIWDNMTWLQWDKEISNYTQIIYGLLEESQNQQEKNEQDLLALD*

>CH848.3.D0949.10.17chim.6R.DS.SOSIP.664_N301A

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATVKNGTVEEMKNCSFNTTTEIRDKEKKEYALFYKPDIVP
LSETNNTSEYRLINCNTSACTQACPKVTFEPIPIHYCAPAGYAILKCNDETFNGTGPCSNVSTVQCTHGIRPVVSTQLLLNGSLAEK
EIVIRSENLTNNAKIIIVHLHTPVEIVCTRPNANTRKSVRIGPGQTFYATGDIIGDIKQAHCNISEEKWNDTLQKVGIELQKHFPNK
TIKYNQSAGGDMEITTHSFNCGGEFFYCNTSNLFNGTYNGTYISTNSSANSTSTITLQCRIKQIINMWQGVGRCMYAPPIAGNIT
CRSNITGLLLTRDGGTNSNETETFRPAGGDMRDNWRSELYKYKVVKIEPLGVAPTRCKRRVVGRRRRRRAVGIGAVFLGFLGAA
GSTMGAASMTLTVQARNLLSGIVQQQSNLLRAPEAQQHLLKLTVWGIKQLQARVLAVERYLRDQQLLGIWGCSGKLICCTNV
PWNSSWSNRNLSEIWDNMTWLQWDKEISNYTQIIYGLLEESQNQQEKNEQDLLALD*

>CH848.3.D0949.10.17chim.6R.DS.SOSIP.664_V1A

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICGSGCSFNTTTEIRDKEKKEYALFYKPDIVPLSETNNTSEYRLIN

Figure 45 continued

CNTSACTQACPKVTFEPIPIHYCAPAGYAILKCNDETFNGTGPCSNVSTVQCTHGIRPVVSTQLLLNGSLAEKEIVIRSENLTNNAK
IIIVHLHTPVEIVCTRPNNNTRKSVRIGPGQTFYATGDIIGDIKQAHCNISEEKWNDTLQKVGIELQKHFPNKTIKYNQSAGGDME
ITTHSFNCGGEFFYCNTSNLFNGTYNGTYISTNSSANSTSTITLQCRIKQIINMWQGVGRCMYAPPIAGNITCRSNITGLLLTRDG
GTNSNETETFRPAGGDMRDNWRSELYKYKVVKIEPLGVAPTRCKRRVVGRRRRRRAVGIGAVFLGFLGAAGSTMGAASMTLT
VQARNLLSGIVQQQSNLLRAPEAQQHLLKLTVWGIKQLQARVLAVERYLRDQQLLGIWGCSGKLICCTNVPWNSSWSNRNLS
EIWDNMTWLQWDKEISNYTQIIYGLLEESQNQQEKNEQDLLALDGS*

> CH848.3.D0949.10.17chim.6R.DS.SOSIP.664_V1B

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNGSGKNCSFNTTTEIRDKEKKEYALFYKPDIVPLSETNNTSE
YRLINCNTSACTQACPKVTFEPIPIHYCAPAGYAILKCNDETFNGTGPCSNVSTVQCTHGIRPVVSTQLLLNGSLAEKEIVIRSENLT
NNAKIIIVHLHTPVEIVCTRPNNNTRKSVRIGPGQTFYATGDIIGDIKQAHCNISEEKWNDTLQKVGIELQKHFPNKTIKYNQSAG
GDMEITTHSFNCGGEFFYCNTSNLFNGTYNGTYISTNSSANSTSTITLQCRIKQIINMWQGVGRCMYAPPIAGNITCRSNITGLL
LTRDGGTNSNETETFRPAGGDMRDNWRSELYKYKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAVERYLRDQQLLGIWGCSGKLICCTNVPWNSSWS
NRNLSEIWDNMTWLQWDKEISNYTQIIYGLLEESQNQQEKNEQDLLALDGS*

> CH848.3.D0949.10.17chim.6R.DS.SOSIP.664_V1D

MGSLQPLATLYLLGMLVASVLAAENLWVTVYYGVPVWKEAKTTLFCASDARAYEKEVHNVWATHACVPTDPSPQELVLGNVT
ENFNMWKNDMVDQMHEDIISLWDQSLKPCVKLTPLCVTLICSNATGSGEMKNCSFNTTTEIRDKEKKEYALFYKPDIVPLSETN
NTSEYRLINCNTSACTQACPKVTFEPIPIHYCAPAGYAILKCNDETFNGTGPCSNVSTVQCTHGIRPVVSTQLLLNGSLAEKEIVIRS
ENLTNNAKIIIVHLHTPVEIVCTRPNNNTRKSVRIGPGQTFYATGDIIGDIKQAHCNISEEKWNDTLQKVGIELQKHFPNKTIKYN
QSAGGDMEITTHSFNCGGEFFYCNTSNLFNGTYNGTYISTNSSANSTSTITLQCRIKQIINMWQGVGRCMYAPPIAGNITCRSNI
TGLLLTRDGGTNSNETETFRPAGGDMRDNWRSELYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARVLAVERYLRDQQLLGIWGCSGKLICCTNVPWNS
SWSNRNLSEIWDNMTWLQWDKEISNYTQIIYGLLEESQNQQEKNEQDLLALDGS*

>CH848.3.D0949.10.17CHIM.6R.SOSIP.664V4.1degly4

MPMGSLQPLATLYLLGMLVASVLAAENLWVTVYYGVPVWKEAKTTLFCASDARAYEKKVHNVWATHACVPTDPSPQELVLG
NVTENFNMWKNDMVDQMHEDIISLWDQSLKPCVKLTPLCVTLICSDATVKTGTVEEMKNCSFNTTTEIRDKEKKEYALFYKPD
IVPLSETNNTSEYRLINCNTSAVTQACPKVTFEPIPIHYCAPAGYAILKCNDETFNGTGPCSNVSTVQCTHGIRPVVSTQLLLNGSL
AEKEIVIRSENLTNNAKIIIVHLHTPVEIVCTRPNDNTRKSVRIGPGQWFYATGDIIGDIKQAHCXHLRGEVERHPAEGGHRAAEA
LPQQDHQVQPVRRRRHGDHHPLLQLRRRVLLLQHLQPVQRHLQRHLHLHQLLRQLHLHHHPAVPHQADHQHVAGRGPRH
VRPPHRRQHHLPLQHHRPAADPRRRHQLQRDRDLPPRRRRHARQLALRAVQVQGGEDRAPGRGPHPLQAPRGGPPPPPPR
RGHRRRVPGLPGRRRLHHGRRLHDPDRAGPQPAVRHRAAAVQPAARPRGPAAPAEADRVGHQAAAGPRAGRGALPARPA
AAGHLGLLRQADLLHQRALELLLVQPQPVRDLGQHDLAAVGQGDLQLHPDHLRPAGGVPEPAGEERAGPAGPGLVSGRGS*

Figure 45 continued

>CH0848.3.D0949.10.17gp140C_degly4

MRVMGILKNYPQWWIWGILGFWMLMICNGKGKLWVTVYYGVPVWKEAKTTLFCASDARAYEKEVHNVWATHACVPTDP
SPQELVLGNVTENFNMWKNDMVDQMHEDIISLWDQSLKPCVKLTPLCVTLICSDATVKTGTVEEMKNCSFNTTTEIRDKEKKE
YALFYKPDIVPLSETNNTSEYRLINCNTSAVTQACPKVTFEPIPIHYCAPAGYAILKCNDETFNGTGPCSNVSTVQCTHGIRPVVST
QLLLNGSLAEKEIVIRSENLTNNAKIIIVHLHTPVEIVCTRPNDNTRKSVRIGPGQTFYATGDIIGDIKQAHCTISEEKWNDTLQKV
GIELQKHFPNKTIKYNQSAGGDMEITTHSFNCGGEFFYCNTSNLFNGTYNGTYISTNSSANSTSTITLQCRIKQIINMWQGVGRA
MYAPPIAGNITCRSNITGLLLTRDGGTNSNETETFRPAGGDMRDNWRSELYKYKVVEIQPLGIAPTGAKERVVEREKEAAGLGA
LFLGFLGAAGSTMGAASITLTVQARQLLSGIVQQQSNLLRAIEAQQHMLQLTVWGIKQLQARVLALERYLKDQQLLGMWGCS
GKLICTTNVPWNTSWSNKSETDIWDNMTWMQWEREISNYTETIYKLLEDSQNQQERNEQDLLALDSWNSLWNWFSITKWL
WYIK*

>B.JRFL gp140C_3QN301SN332T

MPMGSLQPLATLYLLGMLVASCLGVEKLWVTVYYGVPVWKEATTTLFCASDAKAYDTEVHNVWATHACVPTDPNPQEVVLE
NVTEHFNMWKNNMVEQMQEDIISLWDQSLKPCVKLTPLCVTLNCKDVQATQTTQDSEGTMERGEIKNCSFNITTSIRDEVQK
EYALFYKLDVVPIDNNNTSYRLISCDTSVITQACPKISFEPIPIHYCAPAGFAILKCNDKTFNGKGPCKNVSTVQCTHGIRPVVSTQL
LLNGSLAEEEVVIRSDNFTNNAKTIIVQLKESVEINCTRPNSNTRKSIHIGPGRAFYTTGEIIGDIRQAHCTISRAKWNDTLKQIVIKL
REQFENKTIVFNHSSGGDPEIVMHSFNCGGEFFYCNSTQLFNSTWNNNTEGSNNTEGNTITLPCRIKQIINMWQEVGKAMYA
PPIRGQIRCSSNITGLLLTRDGGINENGTEIFRPGGGDMRDNWRSELYKYKVVKIEPLGVAPTKAKTLTVQARLLLSGIVQQQNN
LLRAIEAQQRMLQLTVWGIKQLQARVLAVERYLGDQQLLGIWGCSGKLICTTAVPWNASWSNKSLDRIWNNMTWMEWER
EIDNYTSEIYTLIEESQNQQEKNEQELLELDKWASLWNWFDITKWLW*

>B.JRFL gp120core_mini-V3_v2_degly

MDAMKRGLCCVLLLCGAVFVSPSASMRVTEHFNMWKNNMVEQMQEDIISLWDQSLKPCVKLTPLCVGSGSCDTSVITQACP
KISFEPIPIHYCAPAGFAILKCNDKTFNGKGPCKNVSTVQCTHGIRPVVSTQLLLNGSLAEEEVVIRSDNFTNNAKTIIVQLKESVEI
TCTRPNDNTRPGEIIGDIRQAHCTISRAKWNDTLKQIVIKLREQFENKTIVFNHSSGGDPEIVMHSFNCGGEFFYCNSTQLFNST
WNNNTEGSNNTEGNTITLPCRIKQIINMWQEVGKAMYAPPIRGQIRCSSNITGLLLTRDGGINENGTEIFRPGGGDMRDNWR
SELYKYKVVKIE**

MGSLQPLATLYLLGMLVASVLAAENLWVTVYYGVPVWKEAKTTLFCASDARAYEKEVH
NVWATHACVPTDPSPQELVLGNVTENFNMWKNDMVDQMHEDIISLWDQSLKPCVKLTPLC
VTLICGSGCSFNTTTEIRDKEKKEYALFYKPDIVPLSETNNTSEYRLINCNTSACTQACP
KVTFEPIPIHYCAPAGYAILKCNDETFNGTGPCSNVSTVQCTHGIRPVVSTQLLLNGSLA
EKEIVIRSENLTNNAKIIIVHLHTPVEIVCTRPNNNTRKSVRIGPGQTFYATGDIIGDIK
QAHCNISEEKWNDTLQKVGIELQKHFPNKTIKYNQSAGGDMEITTHSFNCGGEFFYCNTS
NLFNGTYNGTYISTNSSANSTSTITLQCRIKQIINMWQGVGRCMYAPPIAGNITCRSNIT
GLLLTRDGGTNSNETETFRPAGGDMRDNWRSELYKYKVVKIEPLGVAPTRCKRRVVGRRR
RRRAVGIGAVFLGFLGAAGSTMGAASMTLTVQARNLLSGIVQQQSNLLRAPEAQQHLLKL
TVWGIKQLQARVLAVERYLRDQQLLGIWGCSGKLICCTNVPWNSSWSNRNLSEIWDNMTW
LQWDKEISNYTQIIYGLLEESQNQQEKNEQDLLALD*

>HV1301263_V1B

MGSLQPLATLYLLGMLVASVLAAENLWVTVYYGVPVWKEAKTTLFCASDARAYEKEVH
NVWATHACVPTDPSPQELVLGNVTENFNMWKNDMVDQMHEDIISLWDQSLKPCVKLTPLC
VTLICSNGSGKNCSFNTTTEIRDKEKKEYALFYKPDIVPLSETNNTSEYRLINCNTSACT
QACPKVTFEPIPIHYCAPAGYAILKCNDETFNGTGPCSNVSTVQCTHGIRPVVSTQLLLN
GSLAEKEIVIRSENLTNNAKIIIVHLHTPVEIVCTRPNNNTRKSVRIGPGQTFYATGDII
GDIKQAHCNISEEKWNDTLQKVGIELQKHFPNKTIKYNQSAGGDMEITTHSFNCGGEFFY
CNTSNLFNGTYNGTYISTNSSANSTSTITLQCRIKQIINMWQGVGRCMYAPPIAGNITCR
SNITGLLLTRDGGTNSNETETFRPAGGDMRDNWRSELYKYKVVKIEPLGVAPTRCKRRVV
GRRRRRRAVGIGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSWSNRNLSEIWD
NMTWLQWDKEISNYTQIIYGLLEESQNQQEKNEQDLLALD*

MGSLQPLATLYLLGMLVASVLAAENLWVTVYYGVPVWKEAKTTLFCASDARAYEKEVH

NVWATHACVPTDPSPQELVLGNVTENFNMWKNDMVDQMHEDIISLWDQSLKPCVKLTPLC

VTLICSNATGSGEMKNCSFNTTTEIRDKEKKEYALFYKPDIVPLSETNNTSEYRLINCNT

SACTQACPKVTFEPIPIHYCAPAGYAILKCNDETFNGTGPCSNVSTVQCTHGIRPVVSTQ

LLLNGSLAEKEIVIRSENLTNNAKIIIVHLHTPVEIVCTRPNNNTRKSVRIGPGQTFYAT

GDIIGDIKQAHCNISEEKWNDTLQKVGIELQKHFPNKTIKYNQSAGGDMEITTHSFNCGG

EFFYCNTSNLFNGTYNGTYISTNSSANSTSTITLQCRIKQIINMWQGVGRCMYAPPIAGN

ITCRSNITGLLLTRDGGTNSNETETFRPAGGDMRDNWRSELYKYKVVKIEPLGVAPTRCK

RRVVGRRRRRRAVGIGAVFLGFLGAAGSTMGAASMTLTVQARNLLSGIVQQQSNLLRAPE

AQQHLLKLTVWGIKQLQARVLAVERYLRDQQLLGIWGCSGKLICCTNVPWNSSWSNRNLS

EIWDNMTWLQWDKEISNYTQIIYGLLEESQNQQEKNEQDLLALD*

Figure 47A

```
>CH848.3.D0949.10.17chim.6R.DS.SOSIP.664 C-SORTA
ATGCCCATGGGCAGCCTGCAGCCCCTGGCCACCCTGTACCTGCTGGGCATGCTGGTGGCTAGCGTGCTGGCCGCCGAG
AACCTGTGGGTGACCGTGTACTACGGCGTGCCCGTGTGGAAGGAGGCCAAGACCACCCTGTTCTGCGCCTCCGACGCC
CGCGCCTACGAGAAGGAGGTGCACAACGTGTGGGCCACCCACGCCTGCGTGCCCACCGACCCCTCCCCCCAGGAGCTG
GTGCTGGGCAACGTGACCGAGAACTTCAACATGTGGAAGAACGACATGGTGGACCAGATGCACGAGGACATCATCTCC
CTGTGGGACCAGTCCCTGAAGCCCTGCGTGAAGCTGACCCCCCTGTGCGTGACCCTGATCTGCTCCAACGCCACCGTG
AAGAACGGCACCGTGGAGGAGATGAAGAACTGCTCCTTCAACACCACCACCGAGATCCGCGACAAGGAGAAGAAGGAG
TACGCCCTGTTCTACAAGCCCGACATCGTGCCCCTGTCCGAGACCAACAACACCTCCGAGTACCGCCTGATCAACTGC
AACACCTCCGCCTGCACCCAGGCCTGCCCCAAGGTGACCTTCGAGCCCATCCCCATCCACTACTGCGCCCCCGCCGGC
TACGCCATCCTGAAGTGCAACGACGAGACCTTCAACGGCACCGGCCCCTGCTCCAACGTGTCCACCGTGCAGTGCACC
CACGGCATCCGCCCCGTGGTGTCCACCCAGCTGCTGCTGAACGGCTCCCTGGCCGAGAAGGAGATCGTGATCCGCTCC
GAGAACCTGACCAACAACGCCAAGATCATCATCGTGCACCTGCACACCCCCGTGGAGATCGTGTGCACCCGCCCCAAC
AACAACACCCGCAAGTCCGTGCGCATCGGCCCCGGCCAGACCTTCTACGCCACCGGCGACATCATCGGCGACATCAAG
CAGGCCCACTGCAACATCTCCGAGGAGAAGTGGAACGACACCCTGCAGAAGGTGGGCATCGAGCTGCAGAAGCACTTC
CCCAACAAGACCATCAAGTACAACCAGTCCGCCGGCGGCGACATGGAGATCACCACCCACTCCTTCAACTGCGGCGGC
GAGTTCTTCTACTGCAACACCTCCAACCTGTTCAACGGCACCTACAACGGCACCTACATCTCCACCAACTCCTCCGCC
AACTCCACCTCCACCATCACCCTGCAGTGCCGCATCAAGCAGATCATCAACATGTGGCAGGGCGTGGGCCGCTGCATG
TACGCCCCCCCCATCGCCGGCAACATCACCTGCCGCTCCAACATCACCGGCCTGCTGCTGACCCGCGACGGCGGCACC
AACTCCAACGAGACCGAGACCTTCCGCCCCGCCGGCGGCGACATGCGCGACAACTGGCGCTCCGAGCTGTACAAGTAC
AAGGTGGTGAAGATCGAGCCCCTGGGCGTGGCCCCCACCCGCTGCAAGCGCCGCGTGGTGGGCCGCCGCCGCCGCCGC
CGCGCAGTGGGAATCGGAGCCGTCTTCCTGGGCTTTCTGGGAGCAGCTGGCAGCACAATGGGAGCAGCCTCTATGACC
CTGACAGTGCAGGCTCGAAATCTGCTGAGTGGGATCGTGCAGCAGCAGTCAAACCTGCTGCGAGCACCAGAGGCACAG
CAGCATCTGCTGAAGCTGACCGTGTGGGGCATCAAGCAGCTGCAGGCCAGAGTGCTGGCTGTCGAACGGTACCTGAGA
GATCAGCAGCTGCTGGGAATCTGGGGATGCAGCGGAAAGCTGATTTGCTGTACAAACGTGCCCTGGAATAGTTCATGG
TCAAACAGGAATCTGAGCGAGATCTGGGACAATATGACCTGGCTGCAGTGGGATAAGGAAATCAGTAACTACACACAG
ATCATCTATGGCCTGCTGGAGGAATCACAGAACCAGCAGGAGAAAAATGAACAGGACCTGCTGGCCCTGGATCTGCCT
AGCACCGGATGATGA

>CH848.3.D0949.10.17chim.6R.DS.SOSIP.664_C-SORTA
MPMGSLQPLATLYLLGMLVASVLAAENLWVTVYYGVPVWKEAKTTLFCASDARAYEKEVHNVWATHACVPTDPSPQELVLG
NVTENFNMWKNDMVDQMHEDIISLWDQSLKPCVKLTPLCVTLICSNATVKNGTVEEMKNCSFNTTTEIRDKEKKEYALFYKPD
IVPLSETNNTSEYRLINCNTSACTQACPKVTFEPIPIHYCAPAGYAILKCNDETFNGTGPCSNVSTVQCTHGIRPVVSTQLLLNGSL
AEKEIVIRSENLTNNAKIIIVHLHTPVEIVCTRPNNNTRKSVRIGPGQTFYATGDIIGDIKQAHCNISEEKWNDTLQKVGIELQKHF
PNKTIKYNQSAGGDMEITTHSFNCGGEFFYCNTSNLFNGTYNGTYISTNSSANSTSTITLQCRIKQIINMWQGVGRCMYAPPIA
GNITCRSNITGLLLTRDGGTNSNETETFRPAGGDMRDNWRSELYKYKVVKIEPLGVAPTRCKRRVVGRRRRRRAVGIGAVFLGF
LGAAGSTMGAASMTLTVQARNLLSGIVQQQSNLLRAPEAQQHLLKLTVWGIKQLQARVLAVERYLRDQQLLGIWGCSGKLIC
CTNVPWNSSWSNRNLSEIWDNMTWLQWDKEISNYTQIIYGLLEESQNQQEKNEQDLLALDLPSTG**
```

Figure 47A continued

>CH848.3.D0949.10.17chim.6R.DS.SOSIP.664_N-SORTA

ATGCCCATGGGCTCCCTGCAGCCCCTGGCCACCCTGTACCTGCTGGGCATGCTGGTGGCCTCCGTGCT
GGCCGGCGGGGGCGGGGGCGGCGGGGGCGGGGGCGGCGGGGGCGGGGGCGCCGAGAACCTGTGGGTGA
CCGTGTACTACGGCGTGCCCGTGTGGAAGGAGGCCAAGACCACCCTGTTCTGCGCCTCCGACGCCCGC
GCCTACGAGAAGGAGGTGCACAACGTGTGGGCCACCCACGCCTGCGTGCCCACCGACCCCTCCCCCCA
GGAGCTGGTGCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCCCTGTGCGTG
ACCCTGATCTGCTCCAACGCCACCGTGAAGAACGGCACCGTGGAGGAGATGAAGAACTGCTCCTTCAA
CACCACCACCGAGATCCGCGACAAGGAGAAGAAGGAGTACGCCCTGTTCTACAAGCCCGACATCGTGC
CCCTGTCCGAGACCAACAACACCTCCGAGTACCGCCTGATCAACTGCAACACCTCCGCCTGCACCCAG
GCCTGCCCCAAGGTGACCTTCGAGCCCATCCCCATCCACTACTGCGCCCCCGCCGGCTACGCCATCCT
GAAGTGCAACGACGAGACCTTCAACGGCACCGGCCCCTGCTCCAACGTGTCCACCGTGCAGTGCACCC
ACGGCATCCGCCCCGTGGTGTCCACCCAGCTGCTGCTGAACGGCTCCCTGGCCGAGAAGGAGATCGTG
ATCCGCTCCGAGAACCTGACCAACAACGCCAAGATCATCATCGTGCACCTGCACACCCCCGTGGAGAT
CGTGTGCACCCGCCCCAACAACAACACCCGCAAGTCCGTGCGCATCGGCCCCGGCCAGACCTTCTACG
CCACCGGCGACATCATCGGCGACATCAAGCAGGCCCACTGCAACATCTCCGAGGAGAAGTGGAACGAC
ACCCTGCAGAAGGTGGGCATCGAGCTGCAGAAGCACTTCCCCAACAAGACCATCAAGTACAACCAGTC
CGCCGGCGGCGACATGGAGATCACCACCCACTCCTTCAACTGCGGCGGCGAGTTCTTCTACTGCAACA
CCTCCAACCTGTTCAACGGCACCTACAACGGCACCTACATCTCCACCAACTCCTCCGCCAACTCCACC
TCCACCATCACCCTGCAGTGCCGCATCAAGCAGATCATCAACATGTGGCAGGGCGTGGGCCGCTGCAT
GTACGCCCCCCCCATCGCCGGCAACATCACCTGCCGCTCCAACATCACCGGCCTGCTGCTGACCCGCG
ACGGCGGCACCAACTCCAACGAGACCGAGACCTTCCGCCCCGCCGGCGGCGACATGCGCGACAACTGG
CGCTCCGAGCTGTACAAGTACAAGGTGGTGAAGATCGAGCCCCTGGGCGTGGCCCCCACCCGCTGCAA
GCGCCGCGTGGTGGGCCGCCGCCGCCGCCGCCGCGCCGTGGGCATCGGCGCCGTGTTCCTGGGCTTCC
TGGGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAGCT
GACCGTGTGGGGCATCAAGCAGCTGCAGGCCCGCGTGCTGGCCGTGGAGCGCTACCTGCGCGACCAGC
AGCTGCTGGGCATCTGGGGCTGCTCCGGCAAGCTGATCTGCTGCACCAACGTGCCCTGGAACTCCTCC
TGGTCCAACCGCAACCTGTCCGAGATCTGGGACAACATGACCTGGCTGCAGTGGGACAAGGAGATCTC
CAACTACACCCAGATCATCTACGGCCTGCTGGAGGAGTCCCAGAACCAGCAGGAGAAGAACGAGCAGG
ACCTGCTGGCCCTGGACTAG

>CH848.3.D0949.10.17chim.6R.DS.SOSIP.664_N-SORTA

MPMGSLQPLATLYLLGMLVASVLAGGGGGGGGGGGGGGGAENLWVTVYYGVPVWKEAKTTLFCAS
DARAYEKEVHNVWATHACVPTDPSPQELVLGNVTENFNMWKNDMVDQMHEDIISLWDQSLKPCVK
LTPLCVTLICSNATVKNGTVEEMKNCSFNTTTEIRDKEKKEYALFYKPDIVPLSETNNTSEYRLI
NCNTSACTQACPKVTFEPIPIHYCAPAGYAILKCNDETFNGTGPCSNVSTVQCTHGIRPVVSTQL
LLNGSLAEKEIVIRSENLTNNAKIIIVHLHTPVEIVCTRPNNNTRKSVRIGPGQTFYATGDIIGD
IKQAHCNISEEKWNDTLQKVGIELQKHFPNKTIKYNQSAGGDMEITTHSFNCGGEFFYCNTSNLF
NGTYNGTYISTNSSANSTSTITLQCRIKQIINMWQGVGRCMYAPPIAGNITCRSNITGLLLTRDG
GTNSNETETFRPAGGDMRDNWRSELYKYKVVKIEPLGVAPTRCKRRVVGRRRRRRAVGIGAVFLG
FLGAAGSTMGAASMTLTVQARNLLSGIVQQQSNLLRAPEAQQHLLKLTVWGIKQLQARVLAVERY
LRDQQLLGIWGCSGKLICCTNVPWNSSWSNRNLSEIWDNMTWLQWDKEISNYTQIIYGLLEESQN
QQEKNEQDLLALD*

C-terminal modification of SOSIP trimer

N-terminal modification of SOSIP trimer

>HV1301331 N133DN138T,CH848.3.D0949.10.17CHIM.6R.SOSIP.664V4.1 N133DN138T

MPMGSLQPLATLYLLGMLVASVLAAENLWVTVYYGVPVWKEAKTTLFCASDARAYEKKVH
NVWATHACVPTDPSPQELVLGNVTENFNMWKNDMVDQMHEDIISLWDQSLKPCVKLTPLC
VTLICSDATVKTGTVEEMKNCSFNTTTEIRDKEKKEYALFYKPDIVPLSETNNTSEYRLI
NCNTSAVTQACPKVTFEPIPIHYCAPAGYAILKCNDETFNGTGPCSNVSTVQCTHGIRPV
VSTQLLLNGSLAEKEIVIRSENLTNNAKIIIVHLHTPVEIVCTRPNNNTRKSVRIGPGQW
FYATGDIIGDIKQAHCNISEEKWNDTLQKVGIELQKHFPNKTIKYNQSAGGDMEITTHSF
NCGGEFFYCNTSNLFNGTYNGTYISTNSSANSTSTITLQCRIKQIINMWQGVGRAMYAPP
IAGNITCRSNITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALD**

```
                                              1                                                  50
CH848.3.D0949.10.17chim.6R.SOSIP.664v4.1  (1) MPMGSLQPLATLYLLGMLVASVLAAENLWVTVYYGVPVWKEAKTTLFCAS
                       HV1301331_N133DN138T (1) MPMGSLQPLATLYLLGMLVASVLAAENLWVTVYYGVPVWKEAKTTLFCAS
                                 Consensus  (1) MPMGSLQPLATLYLLGMLVASVLAAENLWVTVYYGVPVWKEAKTTLFCAS
                                              51                                                100
CH848.3.D0949.10.17chim.6R.SOSIP.664v4.1 (51) DARAYEKKVHNVWATHACVPTDPSPQELVLGNVTENFNMWKNDMVDQMHE
                      HV1301331_N133DN138T (51) DARAYEKKVHNVWATHACVPTDPSPQELVLGNVTENFNMWKNDMVDQMHE
                                Consensus  (51) DARAYEKKVHNVWATHACVPTDPSPQELVLGNVTENFNMWKNDMVDQMHE
                                              101                                               150
CH848.3.D0949.10.17chim.6R.SOSIP.664v4.1 (101) DIISLWDQSLKPCVKLTPLCVTLICSNATVKNGTVEEMKNCSFNTTTEIR
                      HV1301331_N133DN138T (101) DIISLWDQSLKPCVKLTPLCVTLICSDATVKTGTVEEMKNCSFNTTTEIR
                                Consensus  (101) DIISLWDQSLKPCVKLTPLCVTLICS ATVK GTVEEMKNCSFNTTTEIR
                                              151                                               200
CH848.3.D0949.10.17chim.6R.SOSIP.664v4.1 (151) DKEKKEYALFYKPDIVPLSETNNTSEYRLINCNTSAVTQACPKVTFEPIP
                      HV1301331_N133DN138T (151) DKEKKEYALFYKPDIVPLSETNNTSEYRLINCNTSAVTQACPKVTFEPIP
                                Consensus  (151) DKEKKEYALFYKPDIVPLSETNNTSEYRLINCNTSAVTQACPKVTFEPIP
                                              201                                               250
CH848.3.D0949.10.17chim.6R.SOSIP.664v4.1 (201) IHYCAPAGYAILKCNDETFNGTGPCSNVSTVQCTHGIRPVVSTQLLLNGS
                      HV1301331_N133DN138T (201) IHYCAPAGYAILKCNDETFNGTGPCSNVSTVQCTHGIRPVVSTQLLLNGS
                                Consensus  (201) IHYCAPAGYAILKCNDETFNGTGPCSNVSTVQCTHGIRPVVSTQLLLNGS
                                              251                                               300
CH848.3.D0949.10.17chim.6R.SOSIP.664v4.1 (251) LAEKEIVIRSENLTNNAKIIIVHLHTPVEIVCTRPNNNTRKSVRIGPGQW
                      HV1301331_N133DN138T (251) LAEKEIVIRSENLTNNAKIIIVHLHTPVEIVCTRPNNNTRKSVRIGPGQW
                                Consensus  (251) LAEKEIVIRSENLTNNAKIIIVHLHTPVEIVCTRPNNNTRKSVRIGPGQW
                                              301                                               350
CH848.3.D0949.10.17chim.6R.SOSIP.664v4.1 (301) FYATGDIIGDIKQAHCNISEEKWNDTLQKVGIELQKHFPNKTIKYNQSAG
                      HV1301331_N133DN138T (301) FYATGDIIGDIKQAHCNISEEKWNDTLQKVGIELQKHFPNKTIKYNQSAG
                                Consensus  (301) FYATGDIIGDIKQAHCNISEEKWNDTLQKVGIELQKHFPNKTIKYNQSAG
                                              351                                               400
CH848.3.D0949.10.17chim.6R.SOSIP.664v4.1 (351) GDMEITTHSFNCGGEFFYCNTSNLFNGTYNGTYISTNSSANSTSTITLQC
                      HV1301331_N133DN138T (351) GDMEITTHSFNCGGEFFYCNTSNLFNGTYNGTYISTNSSANSTSTITLQC
                                Consensus  (351) GDMEITTHSFNCGGEFFYCNTSNLFNGTYNGTYISTNSSANSTSTITLQC
                                              401                                               450
CH848.3.D0949.10.17chim.6R.SOSIP.664v4.1 (401) RIKQIINMWQGVGRAMYAPPIAGNITCRSNITGLLLTRDGGTNSNETETF
                      HV1301331_N133DN138T (401) RIKQIINMWQGVGRAMYAPPIAGNITCRSNITGLLLTRDGGTNSNETETF
                                Consensus  (401) RIKQIINMWQGVGRAMYAPPIAGNITCRSNITGLLLTRDGGTNSNETETF
                                              451                                               500
CH848.3.D0949.10.17chim.6R.SOSIP.664v4.1 (451) RPAGGDMRDNWRSELYKYKVVKIEPLGVAPTRCKRRVVGRRRRRRAVGIG
                      HV1301331_N133DN138T (451) RPAGGDMRDNWRSELYKYKVVKIEPLGVAPTRCKRRVVGRRRRRRAVGIG
                                Consensus  (451) RPAGGDMRDNWRSELYKYKVVKIEPLGVAPTRCKRRVVGRRRRRRAVGIG
                                              501                                               550
CH848.3.D0949.10.17chim.6R.SOSIP.664v4.1 (501) AVFLGFLGAAGSTMGAASMTLTVQARNLLSGIVQQQSNLLRAPEAQQHLL
                      HV1301331_N133DN138T (501) AVFLGFLGAAGSTMGAASMTLTVQARNLLSGIVQQQSNLLRAPEAQQHLL
                                Consensus  (501) AVFLGFLGAAGSTMGAASMTLTVQARNLLSGIVQQQSNLLRAPEAQQHLL
                                              551                                               600
CH848.3.D0949.10.17chim.6R.SOSIP.664v4.1 (551) KLTVWGIKQLQARVLAVERYLRDQQLLGIWGCSGKLICCTNVPWNSSWSN
                      HV1301331_N133DN138T (551) KLTVWGIKQLQARVLAVERYLRDQQLLGIWGCSGKLICCTNVPWNSSWSN
                                Consensus  (551) KLTVWGIKQLQARVLAVERYLRDQQLLGIWGCSGKLICCTNVPWNSSWSN
                                              601                                             648
CH848.3.D0949.10.17chim.6R.SOSIP.664v4.1 (601) RNLSEIWDNMTWLQWDKEISNYTQIIYGLLEESQNQQEKNEQDLLALD
                      HV1301331_N133DN138T (601) RNLSEIWDNMTWLQWDKEISNYTQIIYGLLEESQNQQEKNEQDLLALD
                                Consensus  (601) RNLSEIWDNMTWLQWDKEISNYTQIIYGLLEESQNQQEKNEQDLLALD
```

Figure 49A

>CH0848.3.d1305.10.19gp160
MRVTGILRNYPQWWIWGILGFWMLMTCNGEGNLWVTVYYGVPVWKEAKTTLFCASDAKAY
KKEVHNVWATHACVPTDPSPQELFLENVTENFNMWKNDMVDQMHEDIISLWDQSLKPCVK
LTPLCVTLICSTATVNNRAVDEMKNCSFNTTTEIRDKKKKEYALFYRSDVVPLDETNNTSEYR
LINCNTSAVTQACPKVTFEPIPIHYCAPAGYAILKCNDETFNGTGPCSNVSTVQCTHGIRPVVST
QLLLNGSLAEKEIVIRSENLTNNAKIIIVHLHTPVEIVCTRPGHNTRKSVRIGPGQTFYATGDIIG
DIRQAHCNINESKWNETLQKVGIELQKHFPNKTIKYNQSAGGDMEITTHSFNCGGEFFYCNTS
KLFNSTYNGTYISTNSTNSTSYITLQCRIKQIINMWQGVGRAMYAPPIAGNITCRSNITGLLLTR
DGGINNVSNETETFRPAGGDMRDNWRSELYKYKVVEVQPLGIAPTGAKRRVVEREKRAAGLG
ALFLGFLGAAGSTMGAASITLTVQARQLLSGIVQQQSNLLRAIEAQQHMLQLTVWGIKQLQAR
VLALERYLKDQQLLGMWGCSGKLICTTNVPWNTSWSNKSEMDIWNNMTWMQWEREISNY
TETIYMLLEDSQRQQERNEKDLLALDSWNSLWNWFNITNWLWYIKIFIMIVGGLIGLRIVFAV
LSIVNRVRQGYSPLSLQTLTPNPREPDRLRGIEEEGGEQDRDRSIRLVSGFLPIVWDDLRSLCLF
SYHRLRDFLLLAARVVELLGHSSLRGLQRGWEVLKYLGSLVQYWGLELKRSAISLFDTLAIAVA
EGTDRIIELIQGFCRAIRNIPTRIRQGFEASLL*

> HV1301509, CH0848.3.d1305.10.19gp160
GCTAGCGCCACCATGAGAGTGACGGGGATACTGAGGAATTATCCACAATGGTGGATATGGGG
CATCTTAGGCTTTTGGATGCTAATGACTTGTAATGGGGAAGGAAACTTGTGGGTCACAGTCT
ACTATGGGGTACCAGTATGGAAAGAAGCAAAAACTACTCTGTTTTGTGCATCAGATGCCAAA
GCGTATAAGAAAGAAGTGCATAATGTCTGGGCGACACATGCCTGTGTACCCACAGACCCCAG
CCCACAAGAACTGTTTTTGGAAAATGTAACAGAAAATTTTAACATGTGGAAAAATGATATGG
TAGATCAGATGCATGAGGATATAATCAGTCTATGGGATCAAAGCCTAAAGCCATGTGTAAAG
TTGACCCCACTCTGTGTCACTTTAATTTGTAGTACTGCTACTGTTAACAATAGAGCAGTTGA
TGAAATGAAAAATTGCTCCTTCAATACAACCACAGAAATAAGAGATAAGAAAAAGAAGGAA
TATGCACTTTTTTATAGATCTGATGTAGTACCACTTGATGAAACAAACAATACCAGTGAGTA
TAGATTAATAAATTGTAATACCTCAGCCGTAACACAAGCCTGTCCAAAGGTCACTTTTGAAC
CAATTCCTATACATTATTGTGCTCCAGCTGGTTATGCGATTCTAAAGTGCAATGATGAGACA
TTCAATGGAACAGGACCATGCAGTAATGTCAGCACAGTACAATGTACACATGGAATTAGGCC
AGTGGTATCAACCCAACTACTGTTAAATGGTAGTCTGGCAGAAAAAGAGATAGTAATTAGAT
CTGAAAACCTGACAAACAATGCCAAAATAATAATAGTCCATCTTCACACCCCTGTAGAAATT
GTGTGTACAAGGCCCGGCCATAATACAAGGAAAAGTGTGAGAATAGGCCCAGGACAAACATT
CTATGCAACAGGAGACATAATAGGAGATATAAGACAAGCACATTGTAACATTAATGAAAGTA
AATGGAATGAAACTTTACAAAAGGTAGGTATAGAATTGCAAAAACACTTCCCTAATAAGACA
ATAAAGTATAACCAATCCGCAGGAGGAGACATGGAAATTACAACACATAGCTTTAATTGTGG
AGGAGAATTTTTCTATTGCAATACATCAAAGCTGTTTAATAGTACATACAATGGTACATACA
TAAGTACAAACAGCACAAACAGTACTTCATACATCACGCTTCAATGCAGAATAAAACAAATT
ATAAACATGTGGCAGGGGGTAGGAAGAGCAATGTATGCTCCTCCCATTGCAGGAAACATAAC
ATGTAGATCAAATATCACAGGGCTACTATTGACACGTGATGGAGGGATCAATAATGTTAGCA
ACGAGACAGAGACATTCAGGCCTGCAGGAGGAGATATGAGGGATAATTGGAGAAGTGAATTA
TATAAATATAAAGTAGTAGAAGTTCAGCCATTAGGAATAGCACCAACTGGTGCAAAAAGGAG
AGTGGTGGAGAGAGAAAAAAGAGCAGCAGGACTAGGAGCTTTGTTCCTTGGGTTCTTGGGAG
CAGCAGGAAGCACTATGGGCGCAGCATCAATAACGCTGACGGTACAGGCCAGACAATTGTTG
TCTGGTATAGTGCAACAGCAAAGCAATTTGCTGAGGGCTATAGAGGCGCAACAGCATATGTT
GCAACTCACGGTCTGGGGCATCAAGCAGCTCCAGGCAAGAGTCCTGGCTCTGGAAAGATACCT

Figure 49B

AAAGGATCAACAGCTCCTAGGGATGTGGGGCTGCTCTGGAAAACTCATCTGCACCACTAATG
TGCCTTGGAACACTAGTTGGAGTAATAAATCTGAAATGGATATTTGGAATAACATGACATGG
ATGCAGTGGGAAAGAGAAATTAGCAATTACACAGAGACAATATACATGTTGCTTGAAGACTC
GCAACGCCAGCAGGAGAGAAATGAAAAAGATTTACTAGCATTGGACAGTTGGAACAGTCTGT
GGAATTGGTTTAACATAACAAACTGGCTGTGGTATATAAAAATATTCATAATGATAGTAGGG
GGCTTGATAGGTTTAAGAATAGTTTTTGCTGTGCTATCTATAGTGAATAGAGTCAGGCAGGG
ATACTCACCTTTGTCGTTGCAGACCCTTACCCCAAACCCGAGGGAACCCGACAGGCTCAGAGG
AATCGAAGAAGAAGGTGGAGAGCAAGACAGAGACAGATCCATTCGATTAGTGAGCGGATTCT
TGCCAATTGTCTGGGACGACCTGCGGAGCCTGTGCCTCTTCAGTTACCACCGATTGAGAGACT
TTCTATTGCTGGCAGCGAGAGTGGTGGAACTTCTGGGACACAGCAGTCTCAGGGGACTGCAG
AGGGGGTGGGAAGTCCTTAAGTATCTGGGAAGTCTTGTGCAGTATTGGGGTCTGGAACTAAA
AAGGAGTGCTATTAGTCTTTTTGATACCCTAGCAATAGCAGTAGCTGAAGGAACAGATAGGA
TTATAGAATTAATACAAGGATTTTGTAGAGCTATCCGCAACATACCTACAAGAATAAGACAA
GGCTTTGAAGCATCTTTGCTATAATGATCTAGA

Figure 49B continued

>CH848.3.D1305.10.19ch.DS.SOSIP.664
MGSLQPLATLYLLGMLVASVLAAENLWVTVYYGVPVWKEAKTTLFCASDAKAYKKEVHNV
WATHACVPTDPSPQELFLENVTENFNMWKNDMVDQMHEDIISLWDQSLKPCVKLTPLCVT
LICSTATVNNRAVDEMKNCSFNTTTEIRDKKKKEYALFYRSDVVPLDETNNTSEYRLINC
NTSACTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPGHNTRKSVRIGPGQTFY
ATGDIIGDIRQAHCNINESKWNETLQKVGIELQKHFPNKTIKYNQSAGGDMEITTHSFNC
GGEFFYCNTSKLFNSTYNGTYISTNSTNSTSYITLQCRIKQIINMWQGVGRCMYAPPIAG
NITCRSNITGLLLTRDGGINNVSNETETFRPAGGDMRDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD**

Figure 50A

>CH848.3.D0949.10.17CHIM.SOSIPV5.2.8_N133DN138T
MPMGSLQPLATLYLLGMLVASVLAAENLWVTVYYGVPVWKDAETTLFCASDARAYEKKKRN
VWATHCCVPTDPSPQELVLGNVTENFNMWKNDMVDQMHTDIISLWDQSLKPCVKLTPLCVT
LICSDATVKTGTVEEMKNCSFNTTTELRDKEKKEYALFYKPDIVPLSETNNTSEYRLINCNTSA
VTQACPKVTFEPIPIHYCAPAGYAILKCNDETFNGTGPCSNVSTVQCTHGIRPVVSTQLLLNGSL
AEKEIVIRSENLTNNAKIIIVHLHTPVEIVCTRPNNNTRKSVRIGPGQWFYATGDIIGDIKQAHC
NISEEKWNDTLQKVGIELQKHFPNKTIKYNQSAGGDMEITTHSFNCGGEFFYCNTSNLFNGTY
NGTYISTNSSANSTSTITLQCRIKQIINMWQRVGQAMYAPPIAGNITCRSNITGLLLTRDGGTNS
NETETFRPAGGDMRDNWRSELYKYKVVKIEPLGVAPTRCKRRVVGRRRRRRAVGIGAVFLGF
LGAAGSTMGAASMTLTVQARNLLSGIVQQQSNLLRAPECQQHLLKLTVWGIKQLQARVLAVE
RYLRDQQLLGIWGCSGKLICCTNVPWNSSWSNRNLSEIWDNMTWLQWDKEISNYTQIIYGLL
EESQNQQEKNEQDLLALD**

>CH848.3.D0949.10.17SOFA.DS.chSOSIP
MPMGSLQPLATLYLLGMLVASVLAAENLWVTVYYGVPVWKEAKTTLFCASDARAYEKEVH
NVWATHACVPTDPSPQELVLGNVTENFNMWKNDMVDQMHEDIISLWDQSLKPCVKLTPLC
VTLICSNATVKNGTVEEMKNCSFNTTTEIRDKEKKEYALFYKPDIVPISETNNTSEYRLI
NCNTSACTQACPKVTFEPIPIHYCAPAGYAILKCNNETFNGTGPCTNVSTVQCTHGIRPV
VSTQLLLNGSLAEKEIVIRSENLTNNAKIIIVHLNTSVEINCTRPNNNTRKSIRIGPGQT
FYATGDIIGDIKQAHCNISEAKWNDTLQNVSIELQKHFPNKTIKYNQSAGGDMEITTHSF
NCGGEFFYCNTSNLFNGTYNGTYISTNSSANSTSTITLQCRIKQIINMWQGVGRCMYAPP
IAGNITCRSSITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALD**

>CH848.3.D0949.10.17SOFA.DS.chSOSIP_N133N138A
MPMGSLQPLATLYLLGMLVASVLAAENLWVTVYYGVPVWKEAKTTLFCASDARAYEKEVH
NVWATHACVPTDPSPQELVLGNVTENFNMWKNDMVDQMHEDIISLWDQSLKPCVKLTPLC
VTLICSAATVKAGTVEEMKNCSFNTTTEIRDKEKKEYALFYKPDIVPISETNNTSEYRLI
NCNTSACTQACPKVTFEPIPIHYCAPAGYAILKCNNETFNGTGPCTNVSTVQCTHGIRPV
VSTQLLLNGSLAEKEIVIRSENLTNNAKIIIVHLNTSVEINCTRPNNNTRKSIRIGPGQT
FYATGDIIGDIKQAHCNISEAKWNDTLQNVSIELQKHFPNKTIKYNQSAGGDMEITTHSF
NCGGEFFYCNTSNLFNGTYNGTYISTNSSANSTSTITLQCRIKQIINMWQGVGRCMYAPP
IAGNITCRSSITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALD**

Figure 50B

>JRFL_SOSIPv6_V1_PNGS (removed V1 glycosylation sites except N156)
MGSLQPLATLYLLGMLVASCLGVEKLWVTVYYGVPVWKEACTTLFCASDAKAYDTKVRNV
WATHCCVPTDPNPQEVVLENVTEHFNMWKNNMVEQMQEDIISLWDQSLKPCVKLTPLCVT
LNCKDVKATSTTSDSEGTMERGEIKNCSFNITTSIRDKVQKEYALFYKLDVVPIDNNNTS
YRLISCDTSVITQACPKISFEPIPIHYCAPAGFAILKCNDKTFNGKGPCKNVSTVQCTHG
IRPVVSTQLLLNGSLAEEEVVIRSDNFTNNAKTIIVQLKESVEINCTRPNNNTRKSIHIG
PGRWFYTTGEIIGDIRQAHCNISRAKWNDTLKQIVIKLREQFENKTIVFNHSSGGDPEIV
MHSFNCGGEFFYCNSTQLFNSTWNNNTEGSNNTEGNTITLPCRIKQIINMWQEIGKAMYA
PPIRGQIRCSSNITGLLLTRDGGINENGTEIFRPGGGDMRDNWRSELYKYKVVKIEPLGV
APTKCKRRVVGRRRRRRAVGIGAVFLGFLGAAGSTMGAASMTLTVQARQLLSGIVQQQNN
CLRAPECQQRMLQLTVWGIKQLQARVLAVERYLGDQQLLGIWGCSGKLICCTAVPWNASW
SNKSLDRIWNNMTWMEWEREIDNYTSEIYTLIEESQNQQEKNEQELLELD**

Figure 50C

>HV1301521(originally HV1301405_N130D_N135K_N138S_N141S)CON-Schim.6R.DS.SOSIP.664_OPT_N130D_N135K_N138S_N141S
MGSLQPLATLYLLGMLVASVLAAENLWVTVYYGVPVWKEANTTLFCASDAKAYDTEVHNVW
ATHACVPTDPNPQEIVLENVTENFNMWKNNMVEQMHEDIISLWDQSLKPCVKLTPLCVTLD
CTNVKVTSTTSNTEEKGEIKNCSFNITTEIRDKKQKVYALFYRLDVVPIDDNNNNSSNYRLINC
NTSACTQACPKVSFEPIPIHYCAPAGFAILKCNDKKFNGTGPCKNVSTVQCTHGIKPVVSTQLLL
NGSLAEEEIIIRSENITNNAKTIIVQLNESVEINCTRPNNNTRKSIRIGPGQAFYATGDIIGDIRQA
HCNISGTKWNKTLQQVAKKLREHFNNKTIIFKPSSGGDLEITTHSFNCRGEFFYCNTSGLFNST
WIGNGTKNNNNTNDTITLPCRIKQIINMWQGVGQCMYAPPIEGKITCKSNITGLLLTRDGGNN
NTNETEIFRPGGGDMRDNWRSELYKYKVVKIEPLGVAPTRCKRRVVGRRRRRRAVGIGAVFL
GFLGAAGSTMGAASMTLTVQARNLLSGIVQQQSNLLRAPEAQQHLLKLTVWGIKQLQARVLA
VERYLRDQQLLGIWGCSGKLICCTNVPWNSSWSNRNLSEIWDNMTWLQWDKEISNYTQIIYG
LLEESQNQQEKNEQDLLALD**

>HV1301405_N138S_N141S;CON-Schim.6R.DS.SOSIP.664_OPT_N138S_N141S
MGSLQPLATLYLLGMLVASVLAAENLWVTVYYGVPVWKEANTTLFCASDAKAYDTEVHNV
WATHACVPTDPNPQEIVLENVTENFNMWKNNMVEQMHEDIISLWDQSLKPCVKLTPLCVT
LNCTNVNVTSTTSNTEEKGEIKNCSFNITTEIRDKKQKVYALFYRLDVVPIDDNNNNSSN
YRLINCNTSACTQACPKVSFEPIPIHYCAPAGFAILKCNDKKFNGTGPCKNVSTVQCTHG
IKPVVSTQLLLNGSLAEEEIIIRSENITNNAKTIIVQLNESVEINCTRPNNNTRKSIRIG
PGQAFYATGDIIGDIRQAHCNISGTKWNKTLQQVAKKLREHFNNKTIIFKPSSGGDLEIT
THSFNCRGEFFYCNTSGLFNSTWIGNGTKNNNNTNDTITLPCRIKQIINMWQGVGQCMYA
PPIEGKITCKSNITGLLLTRDGGNNNTNETEIFRPGGGDMRDNWRSELYKYKVVKIEPLG
VAPTRCKRRVVGRRRRRRAVGIGAVFLGFLGAAGSTMGAASMTLTVQARNLLSGIVQQQS
NLLRAPEAQQHLLKLTVWGIKQLQARVLAVERYLRDQQLLGIWGCSGKLICCTNVPWNSS
WSNRNLSEIWDNMTWLQWDKEISNYTQIIYGLLEESQNQQEKNEQDLLALD**

Figure 50D

DHVI pjt20171030_Saunders_SOSIPv5.2.8
Use purchase number: PPF

Task 1: Gene synthesis of 1 gene including
SHIVSF162P3.5chim.6R.DS.SOSIP.664 per sequence below.

>T250-4CHIMSOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTTTGGAGGGACGCCGAGACAACACTG
TTTTGTGCCTCCGACGCCAAGGGCTACGACACCAAGGCTAGAAACGTGTGGGCCACACACTGCTGCGTGCCCACA
GATCCTAGACCTCAAGAGATGTACCTGGAAAACGTGACCGAGAACTTCAACATGTGGAAGAACAGCATGGTCGAG
CAGATGCACACCGACATCATCAGCCTGTGGGACGAGAGCCTGAAGCCTTGCGTGAAGCTGACCCCTCTGTGCGTG
ACCCTGGATTGCCAGGCCTTCAATAGCAGCAGCCACACCAACAGCTCTATCGCCATGCAAGAGATGAAGAACTGC
AGCTTCAACGTGACCACCGAGCTGCGGGACAAGAAGAAGAAAGAGTACAGCTTCTTCTACAAGACCGACATTGAG
CAGATCAACAAGAACGGCCGGCAGTACCGGCTGATCAACTGCAACACAAGCGCCATCACACAGGCTTGCCCCAAG
GTGTCCTTCGAGCCTATTCCTATCCACTTCTGTGCCCCTGCCGGCTTCGCCATCCTGAAGTGCAATGAGAAGCAC
TTCAACGGCAAGGGCCCCTGCAAGAACGTGTCCACCGTGCAGTGTACCCACGGCATCAAGCCAGTGGTGTCTACC
CAGCTGCTGCTGAATGGCTCTCTGGCCGAAGAAGAGGTGGTCATCAGAGTGGAAAACACCATCGACAACGCCAAG
ACCATCATCGTGCAGCTGGCTAAGCCCGTGAAGATCAATTGCACCCGGCCTAACAACAACACCAGAAAGAGCATC
CGGATCGGCCCTGGCCAGTGGTTTTATGCCACCGGCGATATCATCGGCAACATCCGGAAGGCCTACTGCAATGTG
TCCAAGAGAGAGTGGAACAATACCCTGCAGCAGGTCGCCGCTCAGCTGTCCAAGTCCTTCAACAATACCAAGATC
GTGTTCGAGAAGCACAGCGGAGGCGACCTGGAAGTGATCACCCACAGCTTTGTGTGTGGCGGCGAGTTCTTCTAC
TGTAACACCAGCGGCCTGTTCAACTCCACCTGGACCAACAGCACCTGGACAAACTCTACCACCGGCAGCAATGGC
ACCGAGAGCAACGACACCATCACTCTGCAGTGCGAGATCAAGCAGTTCATCAATATGTGGCAGCGCGTCGGCCAG
GCTATGTACGCTCCTCCTATTCCTGGCGTGATCAGATGCGAGAGCGACATCACAGGCCTGCTGCTCACAAGAGAT
GGCCCCAATAGCACCCAGAACGAGACATTCAGACCTGGCGGCGGAGACATGAGAGACAATTGGAGAAGCGAGCTG
TACAAGTACAAGGTGGTCAAGATCGAGCCCCTGGGCGTCGCACCTACACGGTGCAAGAGAAGAGTCGTGGGCCGT
CGTAGAAGGCGGAGAGCCGTTGGAATTGGCGCCGTGTTCCTGGGCTTTCTGGGAGCCGCTGGATCTACAATGGGC
GCTGCCAGCATGACCCTGACAGTGCAGGCAAGAAATCTGCTGAGCGGAATCGTCCAGCAGCAGAGCAACCTGCTG
AGAGCCCCTGAGTGTCAGCAGCACCTCCTGAAACTGACCGTGTGGGGAATCAAGCAGCTGCAGGCTAGAGTGCTG
GCTGTGGAAAGATACCTGCGGGACCAGCAGCTCCTCGGCATCTGGGGATGTTCTGGCAAGCTGATCTGCTGCACC
AACGTGCCCTGGAACAGCTCCTGGTCCAACAGAAACCTGAGCGAGATCTGGGACAACATGACCTGGCTGCAGTGG
GACAAAGAGATCAGCAACTACACCCAGATCATCTACGGCCTGCTGGAAGAGAGCCAGAACCAGCAAGAGAAAAAC
GAGCAGGACCTGCTGGCCCTGGACTGATAAGGATCC

>CH848.3.D0949.10.17CHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTGTGGAAGGACGCCGAGACAACACTG
TTTTGCGCCTCCGATGCCAGAGCCTACGAGAAGAAAAAGCGGAACGTGTGGGCCACACACTGCTGCGTGCCAACC
GATCCATCTCCTCAAGAGCTGGTGCTGGGCAACGTGACCGAGAACTTCAACATGTGGAAGAACGACATGGTGGAC
CAGATGCACACCGACATCATCAGCCTGTGGGACCAGAGCCTGAAGCCTTGCGTGAAGCTGACCCCTCTGTGCGTG
ACCCTGATCTGCAGCAATGCCACCGTGAAGAACGGCACCGTGGAAGAGATGAAGAACTGCAGCTTCAACACCACC
ACCGAGCTGCGCGACAAAGAGAAGAAAGAGTACGCCCTGTTCTACAAGCCCGACATCGTGCCCCTGAGCGAGACA
AACAACACCAGCGAGTACCGGCTGATCAACTGCAACACCTCCGCCGTGACACAGGCTTGCCCCAAAGTGACCTTC
GAGCCCATTCCTATCCACTACTGTGCCCCTGCCGGCTACGCCATCCTGAAGTGCAACGACGAGACATTCAACGGC
ACAGGCCCCTGCTCCAATGTGTCCACCGTGCAGTGTACCCACGGCATCAGACCAGTGGTGTCTACCCAGCTGCTG
CTGAATGGAAGCCTGGCCGAGAAAGAAATCGTGATCAGAAGCGAGAACCTGACCAACAACGCCAAGATCATCATC
GTGCATCTGCACACCCCTGTGGAAATCGTGTGCACCCGGCCTAACAACAACACCCGGAAGTCTGTGCGGATCGGC
CCTGGCCAGTGGTTTTATGCCACCGGCGATATCATCGGCGACATCAAGCAGGCCCACTGCAACATCAGCGAGGAA
AAGTGGAACGACACCCTGCAGAAAGTGGGCATCGAGCTGCAGAAGCACTTCCCCAACAAGACCATCAAGTACAAC
CAGAGCGCTGGCGGCGACATGGAAATCACCACACACAGCTTCAATTGTGGCGGCGAGTTCTTCTACTGCAATACC
AGCAACCTGTTCAACGGGACCTACAATGGC

Figure 51

ACCTACATCAGCACCAACAGCAGCGCCAACTCCACCAGCACCATCACTCTGCAGTGCCGGATCAAGCAGATCATC
AATATGTGGCAGCGCGTTGGCCAGGCTATGTACGCCCCTCCTATCGCCGGCAACATCACCTGTCGGAGCAATATC
ACAGGCCTGCTGCTCACCAGAGATGGCGGCACCAATAGCAACGAGACAGAAACCTTCAGACCTGCCGGCGGAGAC
ATGAGAGACAATTGGAGAAGCGAGCTGTACAAGTACAAGGTGGTCAAGATCGAGCCCCTGGGCGTCGCACCTACA
CGGTGCAAGAGAAGAGTCGTGGGCCGTCGTAGAAGGCGGAGAGCCGTTGGAATTGGCGCCGTGTTCCTGGGCTTT
CTGGGAGCCGCTGGATCTACAATGGGCGCTGCCAGCATGACCCTGACAGTGCAGGCTAGAAATCTGCTGAGCGGC
ATCGTGCAGCAGCAGAGCAATCTGCTCAGAGCCCCTGAGTGCCAGCAGCATCTGCTGAAACTGACCGTGTGGGGA
ATCAAGCAGCTGCAGGCAAGAGTGCTGGCTGTGGAAAGATACCTGCGGGACCAGCAGCTCCTCGGCATCTGGGGA
TGTTCTGGCAAGCTGATCTGCTGCACCAACGTGCCCTGGAACAGCTCCTGGTCCAACCGGAATCTGTCCGAGATC
TGGGATAACATGACCTGGCTGCAGTGGGACAAAGAAATCAGCAACTACACCCAGATCATCTACGGCCTGCTGGAA
GAGAGCCAGAACCAGCAAGAGAAAAACGAGCAGGACCTGCTGGCCCTGGACTGATAAGGATCC

>WITOCHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTTTGGAGGGACGCCGAGACAACACTG
TTTTGTGCCTCCGACGCCAAGGCCTACGACACCAAGAAACGGAACGTGTGGGCCACACACTGCTGCGTGCCAACA
GACCCCAATCCTCAAGAGGTGGTCATGGGCAACGTGACCGAGGACTTCAACATGTGGAAGAACAACATGGTCGAG
CAGATGCACACCGACATCATCAGCCTGTGGGACCAGAGCCTGAAGCCTTGCGTGAAGCTGACCCCTCTGTGTGTG
ACCCTGCACTGCACCAATGTGACCATCAGCAGCACCAATGGCAGCACCGCCAACGTGACAATGCGGGAAGAGATG
AAGAACTGCAGCTTCAACACCACCACCGTGCTGCGGGACAAGATCCAGAAAGAGTACGCCCTGTTCTACAAGCTG
GACATCGTGCCCATCGAGGGCAAGAACACCAACACCGGCTACCGGCTGATCAACTGCAACACCAGCGTGATCACC
CAGGCCTGTCCTAAGGTGTCCTTCGAGCCCATTCCTATCCACTACTGTGCCCCTGCCGGCTTCGCCATCCTGAAG
TGCAACAACAAGACCTTCAACGGCAAGGGCCCCTGCAGAAACGTGTCCACCGTGCAGTGTACCCACGGCATCAAG
CCAGTGGTGTCTACCCAGCTGCTGCTGAATGGCTCTCTGGCCGAAGAGGATATCATCATCAGAAGCGAGAACTTC
ACCAACAACGGGAAGAACATCATCGTGCAGCTGAAAGAACCCGTGAAGATCAATTGCACCCGGCCTGGCAACAAC
ACCCGGCGGTCTATCAATATCGGCCCTGGCAGATGGTTCTACGCCACCGGCGCCATCATCGGCGATATCAGAAAG
GCCCACTGCAACATCTCTACCGAGCAGTGGAACAACACACTGACCCAGATCGTGGACAAGCTGAGAGAGCAGTTC
GGCAACAAGACGATCATCTTCAACCAGAGCAGCGGAGGCGACCCCGAGGTTGTGATGCACACATTCAATTGTGGC
GGCGAGTTCTTCTACTGCAACAGCACCCAGCTGTTCAACTCCACCTGGTTCAACAACGGCACCAGCACCTGGAAT
AGCACCGCCGACAATATCACCCTGCCTTGCCGGATCAAGCAAGTGATCAATATGTGGCAGCGCGTCGGCCAGGCT
ATGTACGCCCCTCCTATCAGAGGCCAGATCGACTGCAGCAGCAACATCACCGGCCTGATCCTGACAAGAGATGGC
GGCAGCAACTCCAGCCAGAACGAGACATTCAGACCCGGCGGAGGCAACATGAAGGACAATTGGAGAAGCGAGCTG
TACAAGTACAAGGTGGTCAAGATCGAGCCCCTGGGCGTCGCACCTACACGGTGCAAGAGAAGAGTCGTGGGCCGT
CGTAGAAGGCGGAGAGCCGTTGGAATTGGCGCCGTGTTCCTGGGCTTTCTGGGAGCCGCTGGATCTACAATGGGC
GCTGCCAGCATGACCCTGACAGTGCAGGCTAGAAATCTGCTGAGCGGCATCGTCCAGCAGCAGAGCAATCTGCTC
AGAGCCCCTGAGTGCCAGCAGCATCTGCTGAAACTGACCGTGTGGGGAATCAAGCAGCTGCAGGCAAGAGTGCTG
GCTGTGGAAAGATACCTGCGGGACCAGCAGCTCCTCGGCATCTGGGGATGTTCTGGCAAGCTGATCTGCTGCACC
AACGTGCCCTGGAACAGCTCCTGGTCCAACAGAAACCTGAGCGAGATCTGGGACAACATGACCTGGCTGCAGTGG
GACAAAGAGATCAGCAACTACACCCAGATCATCTACGGCCTGCTGGAAGAGAGCCAGAACCAGCAAGAGAAAAAC
GAGCAGGACCTGCTGGCCCTGGACTGATAAGGATCC

>ZM233CHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTTTGGAGGGACGCCGAGACAACACTG
TTTTGTGCCTCCGACGCCAAGGCCTACGAGACAAAAAAACGCAGCGTGTGGGCCACTCACTGCTGCGTGCCAACC
GATCCTAATCCTCAAGAGATGGTGCTGGAAAACGTGACCGAGAACTTCAACATGTGGAAGAACGACATGGTGGAC
CAGATGCACACCGACGTGATCAGCATCTGGGACCAGAGCCTGAAGCCTTGCGTGAAGCTGACCCCTCTGTGCGTG
ACACTGGACTGCAGCACCTACAACAACACCCACAACATCAGCAAAGAGATGAAGATCTGCAGCTTCAATATGACC
ACCGAGCTGCGGGACAAGAAACGGAAAGTGAACGTGCTGTTCTACAAGCTGGACCTGGTGCCTCTGACCAACAGC
AGCAACACCACCAACTACAGACTGATCAGCTGCAACACCTCCACCATCACACAGGCTTGCCCCAAGGTGTCCTTC
GATCCCATTCCTATCCACTACTGTGCCCCTGCCGGCTACGCCATCCTGAAGTGCAACAACAAGACCTTCAACGGC
ACAGGCCCCTGCAACAACGTGTCCACCGTGCAGTGTACCCACGGCATCAAGCCAGTGGTGTCTACCCAGCTGCTG
CTGAATGGCTCTCTGGCCGAGGAAGAGATCATCATCAGATTCGAGAACCTGACCGACAACGTGAAGATCATTATC
GTGCAGCTGAACGAGACAATCAACATCACATGCACCCGGCCGAACAACAATACCAGAAAGAGCATCCGGATCGGC
CCTGGCCAGTGGTTTTATGCCACC

Figure 51 continued

GGCGAGATCGTGGGCAACATCAGAGAGGCCCACTGCAATATCAGCGCCAGCAAGTGGAACAAGACCCTGGAAAGA
GTGCGGACCAAGCTGAAAGAGCACTTCCCTAACAAGACCATCGAGTTCGAGCCCAGCTCTGGCGGCGACCTGGAA
ATCACCACACACAGCTTTAACTGTGGCGGCGAGTTCTTCTACTGTAACACCAGCGGCCTGTTCAACAGCGCCATC
AATGGCACCCTGACCAGCAATGTGACCCTGCCTTGCCGGATCAAGCAGATCATCAATATGTGGCAGAGAGAAGTC
GGCCAGGCTATGTACGCCCCTCCTATCGCCGGCAACATTACCTGCAAGAGCAACATCACCGGCCTGCTGCTCACC
AGAGATGGCGGAGAGAATAGCAGCTCCACCACCGAGACATTCAGACCCACAGGCGGCGACATGAAGAACAACTGG
CGGAGCGAGCTGTACAAGTACAAGGTGGTCAAGATCGAGCCCCTGGGCGTCGCACCAACACGGTGCAAGAGAAGA
GTCGTGGGCCGTCGTAGAAGGCGGAGAGCCGTTGGAATTGGCGCCGTGTTCCTGGGCTTTCTGGGAGCCGCTGGA
TCTACAATGGGCGCTGCCAGCATGACCCTGACAGTGCAGGCTAGAAATCTGCTGAGCGGCATTGTGCAGCAGCAG
AGCAACCTGCTGAGAGCCCCTGAGTGTCAGCAGCACCTCCTGAAACTGACCGTGTGGGGAATCAAGCAGCTGCAG
GCAAGAGTGCTGGCTGTGGAAAGATACCTGCGGGACCAGCAGCTCCTCGGCATCTGGGGATGTTCTGGCAAGCTG
ATCTGCTGCACCAACGTGCCCTGGAACAGCTCCTGGTCCAACAGAAACCTGAGCGAGATCTGGGATAACATGACC
TGGCTGCAGTGGGACAAAGAGATCAGCAACTACACCCAGATCATCTACGGACTGCTGGAAGAGAGCCAGAACCAG
CAAGAGAAAAACGAGCAGGACCTGCTGGCCCTGGATGGATCC

>A.Q23_17CHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTTTGGAGGGACGCCGAGACAACACTG
TTTTGTGCCTCCGACGCCAAGGCCTACGAGACAAAGAAACGGAACGTGTGGGCCACACACTGCTGCGTGCCAACA
GACCCCAATCCTCAAGAGATCCACCTGGACAACGTGACCGAGAAGTTCAACATGTGGAAGAACAACATGGTCGAG
CAGATGCACACCGACATCATCAGCCTGTGGGACCAGAGCCTGAAGCCTTGCGTGAAGCTGACCCCTCTGTGTGTG
ACCCTGCACTGCACCAATGTGACCAGCGTGAACACCACCGGCGATAGAGAGGGCCTGAAGAACTGCAGCTTCAAC
ATGACCACCGAGCTGCGGGACAAGCGGCAGAAGGTGTACAGCCTGTTCTACCGGCTGGACATCGTGCCCATCAAC
GAGAATCAGGGCAGCGAGTACCGGCTGATCAACTGCAACACCAGCGCCATCACTCAGGCCTGTCCTAAGGTGTCC
TTCGAGCCCATTCCTATCCACTACTGTACCCCTGCCGGCTTCGCCATCCTGAAGTGCAAGGACGAGGGCTTCAAT
GGCACCGGCCTGTGCAAGAATGTGTCCACCGTGCAGTGTACCCACGGCATCAAGCCAGTGGTGTCTACCCAGCTG
CTGCTGAATGGAAGCCTGGCCGAGAAGAACATCACCATCAGAAGCGAGAATATCACCAACAACGCCAAGATCATC
ATCGTGCAGCTGGTGCAGCCCGTGACCATCAAGTGCATCAGACCCAACAACAACACCCGGAAGTCCATCAGAATC
GGCCCTGGCCAGTGGTTTTACGCCACCGGGGATATCATCGGCGACATCAGACAGGCCCACTGCAACGTGACACGG
TCCAGATGGAACAAGACCCTGCAAGAGGTGGCCGAAAAGCTGCGGACCTACTTCGGCAACAAGACCATCATCTTC
GCCAACAGCTCTGGCGGCGACCTGGAAATCACCACACACAGCTTCAATTGTGGCGGCGAGTTCTTCTACTGCAAT
ACCTCCGGCCTGTTCAACAGCACTTGGTACGTGAACAGCACCTGGAACGACACCGACAGCACCCAAGAGAGCAAC
GACACCATCACACTGCCCTGCCGGATCAAGCAGATCATCAATATGTGGCAGCGCGCAGGCCAGGCTATGTACGCT
CCTCCTATTCCTGGCGTGATCAAGTGCGAGAGCAACATCACAGGCCTGCTGCTCACAAGAGATGGCGGCAAGGAC
AACAACGTGAACGAAACCTTCAGACCCGGCGGAGGCGACATGAGAGACAATTGGAGAAGCGAGCTGTACAAGTAC
AAGGTGGTCAAGATCGAGCCCCTGGGCGTCGCACCTACACGGTGCAAGAGAAGAGTCGTGGGCCGTCGTAGAAGG
CGGAGAGCCGTTGGAATTGGCGCCGTGTTCCTGGGCTTTCTGGGAGCCGCTGGATCTACAATGGGCGCTGCCAGC
ATGACCCTGACAGTGCAGGCTAGAAATCTGCTGAGCGGCATCGTCCAGCAGCAGAGCAATCTGCTCAGAGCCCCT
GAGTGCCAGCAGCATCTGCTGAAACTGACCGTGTGGGGAATCAAGCAGCTGCAGGCAAGAGTGCTGGCTGTGGAA
AGATACCTGCGGGACCAGCAGCTCCTCGGCATCTGGGGATGTTCTGGCAAGCTGATCTGCTGCACCAACGTGCCC
TGGAACAGCTCCTGGTCCAACAGAAACCTGAGCGAGATCTGGGACAATATGACCTGGCTGCAGTGGGACAAAGAG
ATCAGCAACTACACCCAGATCATCTACGGCCTGCTGGAAGAGAGCCAGAACCAGCAAGAGAAAAACGAGCAGGAC
CTGCTGGCCCTGGACTGATAAGGATCC

>CM244CHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTTTGGAGGGACGCCGAGACAACACTG
TTTTGCGCCTCCGATGCCAAGGCTCACGAGACAAAGAAACGGAACGTGTGGGCCACACACTGCTGCGTGCCAACA
GACCCCAATCCTCAAGAGATCGACCTGGAAAACGTGACCGAGAACTTCAACATGTGGAAGAACAACATGGTCGAG
CAGATGCAGACCGACGTGATCAGCCTGTGGGACCAGAGCCTGAAGCCTTGCGTGAAGCTGACCCCTCTGTGTGTG
ACCCTGCACTGCACCAACGCCAATCTGACCAAGGCCAACCTGACAAACGTGAACAACCGGACCAACGTGTCCAAC
ATCATCGGCAACATCACCGACGAAGTGCGGAACTGCAGCTTCAATATGACCACCGAGCTGCGGGACAAGAAACAG
AAGGTGCACGCCCTGTTCTACAAGCTGGACATCGTGCCCATCGAGGACAACAACGACAACAGCAAGTACCGGCTG
ATCAACTGCAACACCAGCGTGATCAAGCAGGCCTGTCCTAAGATCAGCTTCGACCCCATTCCTATCCACTACTGC
ACCCCTGCCGGCTACGCC

Figure 51 continued

ATCCTGAAGTGCAACGACAAGAATTTCAACGGCACAGGCCCCTGCAAGAACGTGTCCTCTGTGCAGTGTACCCAC
GGCATCAAGCCCGTGGTGTCTACACAGCTGCTGCTGAATGGCAGCCTGGCCGAGGAAGAGATCATCATCAGAAGC
GAGGACCTGACCAACAACGCCAAGACCATCATCGTGCACCTGAACAAGAGCGTGGTCATCAATTGCACCCGGCCT
AGCAACAACACCCGGACCAGCATCACAATCGGCCCTGGCCAGTGGTTCTACAGAACCGGCGATATCATCGGAGAC
ATCCGGAAGGCCTACTGCGAGATCAATGGCACCGAGTGGAACAAGGCCCTGAAGCAAGTGACAGAGAAGCTGAAA
GAGCACTTCAACAACAAGCCCATCATCTTCCAGCCTCCATCTGGCGGCGATCTGGAAATCACCATGCACCACTTC
AACTGCAGAGGCGAGTTCTTCTACTGCAATACCACCAGGCTGTTCAACAATACCTGTATCGCCAACGGCACCATC
GAGGGCTGCAACGGCAATATCACCCTGCCTTGCAAGATTAAGCAGATCATCAATATGTGGCAGCGCGCAGGCCAG
GCTATGTACGCCCCTCCTATCAGCGGCACAATCAACTGCGTGTCCAATATTACCGGCATCCTGCTGACCAGAGAT
GGCGGAGCCACCAACAACACAAACAACGAGACATTCAGACCCGGCGGAGGAAACATCAAGGACAACTGGCGGAGC
GAGCTGTACAAGTACAAGGTGGTCAAGATCGAGCCCCTGGGCGTCGCACCTACACGGTGCAAGAGAAGAGTCGTG
GGCCGTCGTAGAAGGCGGAGAGCCGTTGGAATTGGCGCCGTGTTCCTGGGCTTTCTGGGAGCCGCTGGATCTACA
ATGGGCGCTGCCAGCATGACCCTGACAGTGCAGGCTAGAAATCTGCTGAGCGGCATCGTGCAGCAGCAGAGCAAT
CTGCTCAGAGCCCCTGAGTGCCAGCAGCATCTGCTGAAACTGACCGTGTGGGGAATCAAGCAGCTGCAGGCAAGA
GTGCTGGCTGTGGAAAGATACCTGCGGGACCAGCAGCTCCTCGGCATCTGGGGATGTTCTGGCAAGCTGATTTGC
TGCACCAATGTGCCCTGGAACAGCAGCTGGTCCAACCGGAATCTGAGCGAGATCTGGGACAACATGACCTGGCTG
CAGTGGGACAAAGAGATCAGCAACTACACCCAGATCATCTACGGCCTGCTGGAAGAGAGCCAGAACCAGCAAGAG
AAAAACGAGCAGGACCTGCTGGCCCTGGATGGATCC

Task 2: Subclone the synthesized genes including, into into plasmid HV10004 at unique SalI and BamHI sites (remove the original insert).

HV10004 plasmid is Kanamycin resistant and has been sent to GenScript and used in the order#165286 by GeneScript.

Task 3 template: CH848.3.D0949.10.17CHIM.SOSIPV5.2.8 in HV10004 vector was previously produced by GenScript as item 1 of this order.

>CH848.3.D0949.10.17CHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTGTGGAAGGACGCCGAGACAACACTG
TTTTGCGCCTCCGATGCCAGAGCCTACGAGAAGAAAAAGCGGAACGTGTGGGCCACACACTGCTGCGTGCCAACC
GATCCATCTCCTCAAGAGCTGGTGCTGGGCAACGTGACCGAGAACTTCAACATGTGGAAGAACGACATGGTGGAC
CAGATGCACACCGACATCATCAGCCTGTGGGACCAGAGCCTGAAGCCTTGCGTGAAGCTGACCCCTCTGTGCGTG
ACCCTGATCTGCAGCAATGCCACCGTGAAGAACGGCACCGTGGAAGAGATGAAGAACTGCAGCTTCAACACCACC
ACCGAGCTGCGCGACAAAGAGAAGAAAGAGTACGCCCTGTTCTACAAGCCCGACATCGTGCCCCTGAGCGAGACA
AACAACACCAGCGAGTACCGGCTGATCAACTGCAACACCTCCGCCGTGACACAGGCTTGCCCCAAAGTGACCTTC
GAGCCCATTCCTATCCACTACTGTGCCCCTGCCGGCTACGCCATCCTGAAGTGCAACGACGAGACATTCAACGGC
ACAGGCCCCTGCTCCAATGTGTCCACCGTGCAGTGTACCCACGGCATCAGACCAGTGGTGTCTACCCAGCTGCTG
CTGAATGGAAGCCTGGCCGAGAAAGAAATCGTGATCAGAAGCGAGAACCTGACCAACAACGCCAAGATCATCATC
GTGCATCTGCACACCCCTGTGGAAATCGTGTGCACCCGGCCTAACAACAACACCCGGAAGTCTGTGCGGATCGGC
CCTGGCCAGTGGTTTTATGCCACCGGCGATATCATCGGCGACATCAAGCAGGCCCACTGCAACATCAGCGAGGAA
AAGTGGAACGACACCCTGCAGAAAGTGGGCATCGAGCTGCAGAAGCACTTCCCCAACAAGACCATCAAGTACAAC
CAGAGCGCTGGCGGCGACATGGAAATCACCACACACAGCTTCAATTGTGGCGGCGAGTTCTTCTACTGCAATACC
AGCAACCTGTTCAACGGGACCTACAATGGCACCTACATCAGCACCAACAGCAGCGCCAACTCCACCAGCACCATC
ACTCTGCAGTGCCGGATCAAGCAGATCATCAATATGTGGCAGCGCGTTGGCCAGGCTATGTACGCCCCTCCTATC
GCCGGCAACATCACCTGTCGGAGCAATATCACAGGCCTGCTGCTCACCAGAGATGGCGGCACCAATAGCAACGAG
ACAGAAACCTTCAGACCTGCCGGCGGAGACATGAGAGACAATTGGAGAAGCGAGCTGTACAAGTACAAGGTGGTC
AAGATCGAGCCCCTGGGCGTCGCACCTACACGGTGCAAGAGAAGAGTCGTGGGCCGTCGTAGAAGGCGGAGAGCC
GTTGGAATTGGCGCCGTGTTCCTGGGCTTTCTGGGAGCCGCTGGATCTACAATGGGCGCTGCCAGCATGACCCTG
ACAGTGCAGGCTAGAAATCTGCTGAGCGGCATCGTGCAGCAGCAGAGCAATCTGCTCAGAGCCCCTGAGTGCCAG
CAGCATCTGCTGAAACTGACCGTGTGGGGAATCAAGCAGCTGCA

Figure 51 continued

GGCAAGAGTGCTGGCTGTGGAAAGATACCTGCGGGACCAGCAGCTCCTCGGCATCTGGGGATGTTCTGGCAAGCT
GATCTGCTGCACCAACGTGCCCTGGAACAGCTCCTGGTCCAACCGGAATCTGTCCGAGATCTGGGATAACATGAC
CTGGCTGCAGTGGGACAAAGAAATCAGCAACTACACCCAGATCATCTACGGCCTGCTGGAAGAGAGCCAGAACCA
GCAAGAGAAAAACGAGCAGGACCTGCTGGCCCTGGACTGATAAGGATCC

Task 3: Using CH848.3.D0949.10.17CHIM.SOSIPV5.2.8 as a template, perform site directed mutagenesis to change:

The A to G at nucleotide position 391
The T to C at nucleotide position 393
The A to C at nucleotide positions 407

The final product should be named
CH848.3.D0949.10.17CHIM.SOSIPV5.2.8_N133DN138T
and have the sequence indicated below between the SalI and BamHI sites in HV10004 vector.

>CH848.3.D0949.10.17CHIM.SOSIPV5.2.8_N133DN138T
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTGTGGAAGGACGCCGAGACAACACTG
TTTTGCGCCTCCGATGCCAGAGCCTACGAGAAGAAAAAGCGGAACGTGTGGGCCACACACTGCTGCGTGCCAACC
GATCCATCTCCTCAAGAGCTGGTGCTGGGCAACGTGACCGAGAACTTCAACATGTGGAAGAACGACATGGTGGAC
CAGATGCACACCGACATCATCAGCCTGTGGGACCAGAGCCTGAAGCCTTGCGTGAAGCTGACCCCTCTGTGCGTG
ACCCTGATCTGCAGCGACGCCACCGTGAAGACCGGCACCGTGGAAGAGATGAAGAACTGCAGCTTCAACACCACC
ACCGAGCTGCGCGACAAAGAGAAGAAAGAGTACGCCCTGTTCTACAAGCCCGACATCGTGCCCCTGAGCGAGACA
AACAACACCAGCGAGTACCGGCTGATCAACTGCAACACCTCCGCCGTGACACAGGCTTGCCCCAAAGTGACCTTC
GAGCCCATTCCTATCCACTACTGTGCCCCTGCCGGCTACGCCATCCTGAAGTGCAACGACGAGACATTCAACGGC
ACAGGCCCCTGCTCCAATGTGTCCACCGTGCAGTGTACCCACGGCATCAGACCAGTGGTGTCTACCCAGCTGCTG
CTGAATGGAAGCCTGGCCGAGAAAGAAATCGTGATCAGAAGCGAGAACCTGACCAACAACGCCAAGATCATCATC
GTGCATCTGCACACCCCTGTGGAAATCGTGTGCACCCGGCCTAACAACAACACCCGGAAGTCTGTGCGGATCGGC
CCTGGCCAGTGGTTTTATGCCACCGGCGATATCATCGGCGACATCAAGCAGGCCCACTGCAACATCAGCGAGGAA
AAGTGGAACGACACCCTGCAGAAAGTGGGCATCGAGCTGCAGAAGCACTTCCCCAACAAGACCATCAAGTACAAC
CAGAGCGCTGGCGGCGACATGGAAATCACCACACACAGCTTCAATTGTGGCGGCGAGTTCTTCTACTGCAATACC
AGCAACCTGTTCAACGGGACCTACAATGGCACCTACATCAGCACCAACAGCAGCGCCAACTCCACCAGCACCATC
ACTCTGCAGTGCCGGATCAAGCAGATCATCAATATGTGGCAGCGCGTTGGCCAGGCTATGTACGCCCCTCCTATC
GCCGGCAACATCACCTGTCGGAGCAATATCACAGGCCTGCTGCTCACCAGAGATGGCGGCACCAATAGCAACGAG
ACAGAAACCTTCAGACCTGCCGGCGGAGACATGAGAGACAATTGGAGAAGCGAGCTGTACAAGTACAAGGTGGTC
AAGATCGAGCCCCTGGGCGTCGCACCTACACGGTGCAAGAGAAGAGTCGTGGGCCGTCGTAGAAGGCGGAGAGCC
GTTGGAATTGGCGCCGTGTTCCTGGGCTTTCTGGGAGCCGCTGGATCTACAATGGGCGCTGCCAGCATGACCCTG
ACAGTGCAGGCTAGAAATCTGCTGAGCGGCATCGTGCAGCAGCAGAGCAATCTGCTCAGAGCCCCTGAGTGCCAG
CAGCATCTGCTGAAACTGACCGTGTGGGGAATCAAGCAGCTGCAGGCAAGAGTGCTGGCTGTGGAAAGATACCTG
CGGGACCAGCAGCTCCTCGGCATCTGGGGATGTTCTGGCAAGCTGATCTGCTGCACCAACGTGCCCTGGAACAGC
TCCTGGTCCAACCGGAATCTGTCCGAGATCTGGGATAACATGACCTGGCTGCAGTGGGACAAAGAAATCAGCAAC
TACACCCAGATCATCTACGGCCTGCTGGAAGAGAGCCAGAACCAGCAAGAGAAAAACGAGCAGGACCTGCTGGCC
CTGGACTGATAAGGATCC

Task 4 template: CH848.3.D0949.10.17CHIM.SOSIPV5.2.8 in HV10004 vector was previously produced by GenScript as item 1 of this order.

>CH848.3.D0949.10.17CHIM.SOSIPV5.2.8
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTGTGGAAGGACGCCGAGACAACACTG
TTTTGCGCCTCCGATGCCAGAGCCTACGAGAAGAAAAAGCGGAACGTGTGGGCCACACACTGCTGCGTGCCAACC
GATCCA

Figure 51 continued

TCTCCTCAAGAGCTGGTGCTGGGCAACGTGACCGAGAACTTCAACATGTGGAAGAACGACATGGTGGACCAGATG
CACACCGACATCATCAGCCTGTGGGACCAGAGCCTGAAGCCTTGCGTGAAGCTGACCCCTCTGTGCGTGACCCTG
ATCTGCAGCAATGCCACCGTGAAGAACGGCACCGTGGAAGAGATGAAGAACTGCAGCTTCAACACCACCACCGAG
CTGCGCGACAAAGAGAAGAAAGAGTACGCCCTGTTCTACAAGCCCGACATCGTGCCCCTGAGCGAGACAAACAAC
ACCAGCGAGTACCGGCTGATCAACTGCAACACCTCCGCCGTGACACAGGCTTGCCCCAAAGTGACCTTCGAGCCC
ATTCCTATCCACTACTGTGCCCCTGCCGGCTACGCCATCCTGAAGTGCAACGACGAGACATTCAACGGCACAGGC
CCCTGCTCCAATGTGTCCACCGTGCAGTGTACCCACGGCATCAGACCAGTGGTGTCTACCCAGCTGCTGCTGAAT
GGAAGCCTGGCCGAGAAAGAAATCGTGATCAGAAGCGAGAACCTGACCAACAACGCCAAGATCATCATCGTGCAT
CTGCACACCCCTGTGGAAATCGTGTGCACCCGGCCTAACAACAACACCCGGAAGTCTGTGCGGATCGGCCCTGGC
CAGTGGTTTTATGCCACCGGCGATATCATCGGCGACATCAAGCAGGCCCACTGCAACATCAGCGAGGAAAAGTGG
AACGACACCCTGCAGAAAGTGGGCATCGAGCTGCAGAAGCACTTCCCCAACAAGACCATCAAGTACAACCAGAGC
GCTGGCGGCGACATGGAAATCACCACACACAGCTTCAATTGTGGCGGCGAGTTCTTCTACTGCAATACCAGCAAC
CTGTTCAACGGGACCTACAATGGCACCTACATCAGCACCAACAGCAGCGCCAACTCCACCAGCACCATCACTCTG
CAGTGCCGGATCAAGCAGATCATCAATATGTGGCAGCGCGTTGGCCAGGCTATGTACGCCCCTCCTATCGCCGGC
AACATCACCTGTCGGAGCAATATCACAGGCCTGCTGCTCACCAGAGATGGCGGCACCAATAGCAACGAGACAGAA
ACCTTCAGACCTGCCGGCGGAGACATGAGAGACAATTGGAGAAGCGAGCTGTACAAGTACAAGGTGGTCAAGATC
GAGCCCCTGGGCGTCGCACCTACACGGTGCAAGAGAAGAGTCGTGGGCCGTCGTAGAAGGCGGAGAGCCGTTGGA
ATTGGCGCCGTGTTCCTGGGCTTTCTGGGAGCCGCTGGATCTACAATGGGCGCTGCCAGCATGACCCTGACAGTG
CAGGCTAGAAATCTGCTGAGCGGCATCGTGCAGCAGCAGAGCAATCTGCTCAGAGCCCCTGAGTGCCAGCAGCAT
CTGCTGAAACTGACCGTGTGGGGAATCAAGCAGCTGCAGGCAAGAGTGCTGGCTGTGGAAAGATACCTGCGGGAC
CAGCAGCTCCTCGGCATCTGGGGATGTTCTGGCAAGCTGATCTGCTGCACCAACGTGCCCTGGAACAGCTCCTGG
TCCAACCGGAATCTGTCCGAGATCTGGGATAACATGACCTGGCTGCAGTGGGACAAAGAAATCAGCAACTACACC
CAGATCATCTACGGCCTGCTGGAAGAGAGCCAGAACCAGCAAGAGAAAAACGAGCAGGACCTGCTGGCCCTGGAC
TGATAAGGATCC

Task 4: Using CH848.3.D0949.10.17CHIM.SOSIPV5.2.8 as a template, perform site directed mutagenesis to change:

The AA to GC at nucleotide position 871-872

The final product should be named CH848.3.D0949.10.17CHIM.SOSIPV5.2.8_N301A and have the sequence indicated below between the SalI and BamHI sites in HV10004 vector.

>CH848.3.D0949.10.17CHIM.SOSIPV5.2.8_N301A
GTCGACGCCACCATGCCTATGGGATCTCTGCAGCCTCTGGCCACACTGTACCTGCTGGGAATGCTGGTGGCTTCT
GTGCTGGCCGCCGAGAATCTGTGGGTCACAGTGTACTATGGCGTGCCCGTGTGGAAGGACGCCGAGACAACACTG
TTTTGCGCCTCCGATGCCAGAGCCTACGAGAAGAAAAAGCGGAACGTGTGGGCCACACACTGCTGCGTGCCAACC
GATCCATCTCCTCAAGAGCTGGTGCTGGGCAACGTGACCGAGAACTTCAACATGTGGAAGAACGACATGGTGGAC
CAGATGCACACCGACATCATCAGCCTGTGGGACCAGAGCCTGAAGCCTTGCGTGAAGCTGACCCCTCTGTGCGTG
ACCCTGATCTGCAGCAATGCCACCGTGAAGAACGGCACCGTGGAAGAGATGAAGAACTGCAGCTTCAACACCACC
ACCGAGCTGCGCGACAAAGAGAAGAAAGAGTACGCCCTGTTCTACAAGCCCGACATCGTGCCCCTGAGCGAGACA
AACAACACCAGCGAGTACCGGCTGATCAACTGCAACACCTCCGCCGTGACACAGGCTTGCCCCAAAGTGACCTTC
GAGCCCATTCCTATCCACTACTGTGCCCCTGCCGGCTACGCCATCCTGAAGTGCAACGACGAGACATTCAACGGC
ACAGGCCCCTGCTCCAATGTGTCCACCGTGCAGTGTACCCACGGCATCAGACCAGTGGTGTCTACCCAGCTGCTG
CTGAATGGAAGCCTGGCCGAGAAAGAAATCGTGATCAGAAGCGAGAACCTGACCAACAACGCCAAGATCATCATC
GTGCATCTGCACACCCCTGTGGAAATCGTGTGCACCCGGCCTAACGCCAACACCCGGAAGTCTGTGCGGATCGGC
CCTGGCCAGTGGTTTTATGCCACCGGCGATATCATCGGCGACATCAAGCAGGCCCACTGCAACATCAGCGAGGAA
AAGTGGAACGACACCCTGCAGAAAGTGGGCATCGAGCTGCAGAAGCACTTCCCCAACAAGACCATCAAGTACAAC
CAGAGCGCTGGCGGCGACATGGAAATCACCACACACAGCTTCAATTGTGGCGGCGAGTTCTTCTACTGCAATACC
AGCAACCTGTTCAACGGGACCTACAATGGCACCTACATCAGCACCAACAGCAGCGCCAACTCCACCAGCACCATC
ACTCTGCAGTGCCGGATCAAGCAGATCATCAATATGTGGCAGCGCGTTGGCCAGGCTATGTACGCCCCTCCTATC
GCCGGCAACATCACCTGTCGGAGCAATATCACAGGCCTGCTGCTCACCAGAGATGGCGGCACCAATAGCAACGAG
ACAGAAACCTTCAGACCTGCCGGCGGAGACATGAGAGACAATTGGAGAAGCGAGCTGTACAAGTACAAGGTGGTC
AAGATCGAGCCCCTGGGCGTCGCACCTACACGGTGCAA

Figure 51 continued

GAGAAGAGTCGTGGGCCGTCGTAGAAGGCGGAGAGCCGTTGGAATTGGCGCCGTGTTCCTGGGCTTTCTGGGAGC
CGCTGGATCTACAATGGGCGCTGCCAGCATGACCCTGACAGTGCAGGCTAGAAATCTGCTGAGCGGCATCGTGCA
GCAGCAGAGCAATCTGCTCAGAGCCCCTGAGTGCCAGCAGCATCTGCTGAAACTGACCGTGTGGGGAATCAAGCA
GCTGCAGGCAAGAGTGCTGGCTGTGGAAAGATACCTGCGGGACCAGCAGCTCCTCGGCATCTGGGGATGTTCTGG
CAAGCTGATCTGCTGCACCAACGTGCCCTGGAACAGCTCCTGGTCCAACCGGAATCTGTCCGAGATCTGGGATAA
CATGACCTGGCTGCAGTGGGACAAAGAAATCAGCAACTACACCCAGATCATCTACGGCCTGCTGGAAGAGAGCCA
GAACCAGCAAGAGAAAAACGAGCAGGACCTGCTGGCCCTGGACTGATAAGGATCC

Figure 51 continued

>CH848d949.10.17_N133DN138T_SOSIPv5.2.8gp160

MPMGSLQPLATLYLLGMLVASVLAAENLWVTVYYGVPVWKDAETTLFCASDARAYEKKKRNVWATHCCVPTDPSP
QELVLGNVTENFNMWKNDMVDQMHTDIISLWDQSLKPCVKLTPLCVTLICSDATVKTGTVEEMKNCSFNTTTELR
DKEKKEYALFYKPDIVPLSETNNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVHLHTPVEIVCTRPNNNTRKSVRIGPGQW
FYATGDIIGDIKQAHCNISEEKWNDTLQKVGIELQKHFPNKTIKYNQSAGGDMEITTHSFNCGGEFFYCNTSNLF
NGTYNGTYISTNSSANSTSTITLQCRIKQIINMWQRVGQAMYAPPIAGNITCRSNITGLLLTRDGGTNSNETETF
RPAGGDMRDNWRSELYKYKVVKIEPLGVAPTRCKRRVVGRRRRRRAVGIGAVFLGFLGAAGSTMGAASMTLTVQA
RNLLSGIVQQQSNLLRAPECQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALDKWASLWNWFDISNWLWYIKIFIMIVGG
LIGLRIVFAVLSVIHRVRQGYSPLSFQTHTPNPRGLDRPERIEEEDGEQDRGRSTRLVSGFLALAWDDLRSLCLF
CYHRLRDFILIAARIVELLGHSSLKGLRLGWEGLKYLWNLLAYWGRELKISAINLFDTIAIAVAEWTDRVIEIGQ
RLCRAFLHIPRRIRQGLERALL**

Figure 52A

```
                                                 1                                                50
   CH848d949.10.17_N133DN138T_SOSIPv5.2.8     (1) MPMGSLQPLATLYLLGMLVASVLAAENLWVTVYYGVPVWKDAETTLFCAS
CH848d949.10.17_N133DN138T_SOSIPv5.2.8gp160   (1) MPMGSLQPLATLYLLGMLVASVLAAENLWVTVYYGVPVWKDAETTLFCAS
                                 Consensus    (1) MPMGSLQPLATLYLLGMLVASVLAAENLWVTVYYGVPVWKDAETTLFCAS
                                                  51                                              100
   CH848d949.10.17_N133DN138T_SOSIPv5.2.8    (51) DARAYEKKKRNVWATHCCVPTDPSPQELVLGNVTENFNMWKNDMVDQMHT
CH848d949.10.17_N133DN138T_SOSIPv5.2.8gp160  (51) DARAYEKKKRNVWATHCCVPTDPSPQELVLGNVTENFNMWKNDMVDQMHT
                                 Consensus   (51) DARAYEKKKRNVWATHCCVPTDPSPQELVLGNVTENFNMWKNDMVDQMHT
                                                  101                                             150
   CH848d949.10.17_N133DN138T_SOSIPv5.2.8   (101) DIISLWDQSLKPCVKLTPLCVTLICSDATVKTGTVEEMKNCSFNTTTELR
CH848d949.10.17_N133DN138T_SOSIPv5.2.8gp160 (101) DIISLWDQSLKPCVKLTPLCVTLICSDATVKTGTVEEMKNCSFNTTTELR
                                 Consensus  (101) DIISLWDQSLKPCVKLTPLCVTLICSDATVKTGTVEEMKNCSFNTTTELR
                                                  151                                             200
   CH848d949.10.17_N133DN138T_SOSIPv5.2.8   (151) DKEKKEYALFYKPDIVPLSETNNTSEYRLINCNTSAVTQACPKVTFEPIP
CH848d949.10.17_N133DN138T_SOSIPv5.2.8gp160 (151) DKEKKEYALFYKPDIVPLSETNNTSEYRLINCNTSAVTQACPKVTFEPIP
                                 Consensus  (151) DKEKKEYALFYKPDIVPLSETNNTSEYRLINCNTSAVTQACPKVTFEPIP
                                                  201                                             250
   CH848d949.10.17_N133DN138T_SOSIPv5.2.8   (201) IHYCAPAGYAILKCNDETFNGTGPCSNVSTVQCTHGIRPVVSTQLLLNGS
CH848d949.10.17_N133DN138T_SOSIPv5.2.8gp160 (201) IHYCAPAGYAILKCNDETFNGTGPCSNVSTVQCTHGIRPVVSTQLLLNGS
                                 Consensus  (201) IHYCAPAGYAILKCNDETFNGTGPCSNVSTVQCTHGIRPVVSTQLLLNGS
                                                  251                                             300
   CH848d949.10.17_N133DN138T_SOSIPv5.2.8   (251) LAEKEIVIRSENLTNNAKIIIVHLHTPVEIVCTRPNNNTRKSVRIGPGQW
CH848d949.10.17_N133DN138T_SOSIPv5.2.8gp160 (251) LAEKEIVIRSENLTNNAKIIIVHLHTPVEIVCTRPNNNTRKSVRIGPGQW
                                 Consensus  (251) LAEKEIVIRSENLTNNAKIIIVHLHTPVEIVCTRPNNNTRKSVRIGPGQW
                                                  301                                             350
   CH848d949.10.17_N133DN138T_SOSIPv5.2.8   (301) FYATGDIIGDIKQAHCNISEEKWNDTLQKVGIELQKHFPNKTIKYNQSAG
CH848d949.10.17_N133DN138T_SOSIPv5.2.8gp160 (301) FYATGDIIGDIKQAHCNISEEKWNDTLQKVGIELQKHFPNKTIKYNQSAG
                                 Consensus  (301) FYATGDIIGDIKQAHCNISEEKWNDTLQKVGIELQKHFPNKTIKYNQSAG
                                                  351                                             400
   CH848d949.10.17_N133DN138T_SOSIPv5.2.8   (351) GDMEITTHSFNCGGEFFYCNTSNLFNGTYNGTYISTNSSANSTSTITLQC
CH848d949.10.17_N133DN138T_SOSIPv5.2.8gp160 (351) GDMEITTHSFNCGGEFFYCNTSNLFNGTYNGTYISTNSSANSTSTITLQC
                                 Consensus  (351) GDMEITTHSFNCGGEFFYCNTSNLFNGTYNGTYISTNSSANSTSTITLQC
                                                  401                                             450
   CH848d949.10.17_N133DN138T_SOSIPv5.2.8   (401) RIKQIINMWQRVGQAMYAPPIAGNITCRSNITGLLLTRDGGTNSNETETF
CH848d949.10.17_N133DN138T_SOSIPv5.2.8gp160 (401) RIKQIINMWQRVGQAMYAPPIAGNITCRSNITGLLLTRDGGTNSNETETF
                                 Consensus  (401) RIKQIINMWQRVGQAMYAPPIAGNITCRSNITGLLLTRDGGTNSNETETF
```

Figure 52B

```
                                                     451                                                500
   CH848d949.10.17_N133DN138T_SOSIPv5.2.8      (451) RPAGGDMRDNWRSELYKYKVVKIEPLGVAPTRCKRRVVGRRRRRRAVGIG
CH848d949.10.17_N133DN138T_SOSIPv5.2.8gp160    (451) RPAGGDMRDNWRSELYKYKVVKIEPLGVAPTRCKRRVVGRRRRRRAVGIG
                                   Consensus   (451) RPAGGDMRDNWRSELYKYKVVKIEPLGVAPTRCKRRVVGRRRRRRAVGIG
                                                     501                                                550
   CH848d949.10.17_N133DN138T_SOSIPv5.2.8      (501) AVFLGFLGAAGSTMGAASMTLTVQARNLLSGIVQQQSNLLRAPECQQHLL
CH848d949.10.17_N133DN138T_SOSIPv5.2.8gp160    (501) AVFLGFLGAAGSTMGAASMTLTVQARNLLSGIVQQQSNLLRAPECQQHLL
                                   Consensus   (501) AVFLGFLGAAGSTMGAASMTLTVQARNLLSGIVQQQSNLLRAPECQQHLL
                                                     551                                                600
   CH848d949.10.17_N133DN138T_SOSIPv5.2.8      (551) KLTVWGIKQLQARVLAVERYLRDQQLLGIWGCSGKLICCTNVPWNSSWSN
CH848d949.10.17_N133DN138T_SOSIPv5.2.8gp160    (551) KLTVWGIKQLQARVLAVERYLRDQQLLGIWGCSGKLICCTNVPWNSSWSN
                                   Consensus   (551) KLTVWGIKQLQARVLAVERYLRDQQLLGIWGCSGKLICCTNVPWNSSWSN
                                                     601                                                650
   CH848d949.10.17_N133DN138T_SOSIPv5.2.8      (601) RNLSEIWDNMTWLQWDKEISNYTQIIYGLLEESQNQQEKNEQDLLALD--
CH848d949.10.17_N133DN138T_SOSIPv5.2.8gp160    (601) RNLSEIWDNMTWLQWDKEISNYTQIIYGLLEESQNQQEKNEQDLLALDKW
                                   Consensus   (601) RNLSEIWDNMTWLQWDKEISNYTQIIYGLLEESQNQQEKNEQDLLALD
                                                     651                                                700
   CH848d949.10.17_N133DN138T_SOSIPv5.2.8      (649) --------------------------------------------------
CH848d949.10.17_N133DN138T_SOSIPv5.2.8gp160    (651) ASLWNWFDISNWLWYIKIFIMIVGGLIGLRIVFAVLSVIHRVRQGYSPLS
                                   Consensus   (651)
                                                     701                                                750
   CH848d949.10.17_N133DN138T_SOSIPv5.2.8      (649) --------------------------------------------------
CH848d949.10.17_N133DN138T_SOSIPv5.2.8gp160    (701) FQTHTPNPRGLDRPERIEEEDGEQDRGRSTRLVSGFLALAWDDLRSLCLF
                                   Consensus   (701)
                                                     751                                                800
   CH848d949.10.17_N133DN138T_SOSIPv5.2.8      (649) --------------------------------------------------
CH848d949.10.17_N133DN138T_SOSIPv5.2.8gp160    (751) CYHRLRDFILIAARIVELLGHSSLKGLRLGWEGLKYLWNLLAYWGRELKI
                                   Consensus   (751)
                                                     801                                               849
   CH848d949.10.17_N133DN138T_SOSIPv5.2.8      (649) -------------------------------------------------
CH848d949.10.17_N133DN138T_SOSIPv5.2.8gp160    (801) SAINLFDTIAIAVAEWTDRVIEIGQRLCRAFLHIPRRIRQGLERALL--
                                   Consensus   (801)
```

Figure 52B continued

>CH848.3.D0949.10.17CHIM.SOSIPV5.2.8_N133DN138T
MPMGSLQPLATLYLLGMLVASVLAAENLWVTVYYGVPVWKDAETTLF
CASDARAYEKKKRNVWATHCCVPTDPSPQELVLGNVTENFNMWKNDM
VDQMHTDIISLWDQSLKPCVKLTPLCVTLICSDATVKTGTVEEMKNC
SFNTTTELRDKEKKEYALFYKPDIVPLSETNNTSEYRLINCNTSAVT
QACPKVTFEPIPIHYCAPAGYAILKCNDETFNGTGPCSNVSTVQCTH
GIRPVVSTQLLLNGSLAEKEIVIRSENLTNNAKIIIVHLHTPVEIVC
TRPNNNTRKSVRIGPGQWFYATGDIIGDIKQAHCNISEEKWNDTLQK
VGIELQKHFPNKTIKYNQSAGGDMEITTHSFNCGGEFFYCNTSNLFN
GTYNGTYISTNSSANSTSTITLQCRIKQIINMWQRVGQAMYAPPIAG
NITCRSNITGLLLTRDGGTNSNETETFRPAGGDMRDNWRSELYKYKV
VKIEPLGVAPTRCKRRVVGRRRRRRAVGIGAVFLGFLGAAGSTMGAA
SMTLTVQARNLLSGIVQQQSNLLRAPECQQHLLKLTVWGIKQLQARV
LAVERYLRDQQLLGIWGCSGKLICCTNVPWNSSWSNRNLSEIWDNMT
WLQWDKEISNYTQIIYGLLEESQNQQEKNEQDLLALD**

Figure 53A

Mutations to make v5.2.8

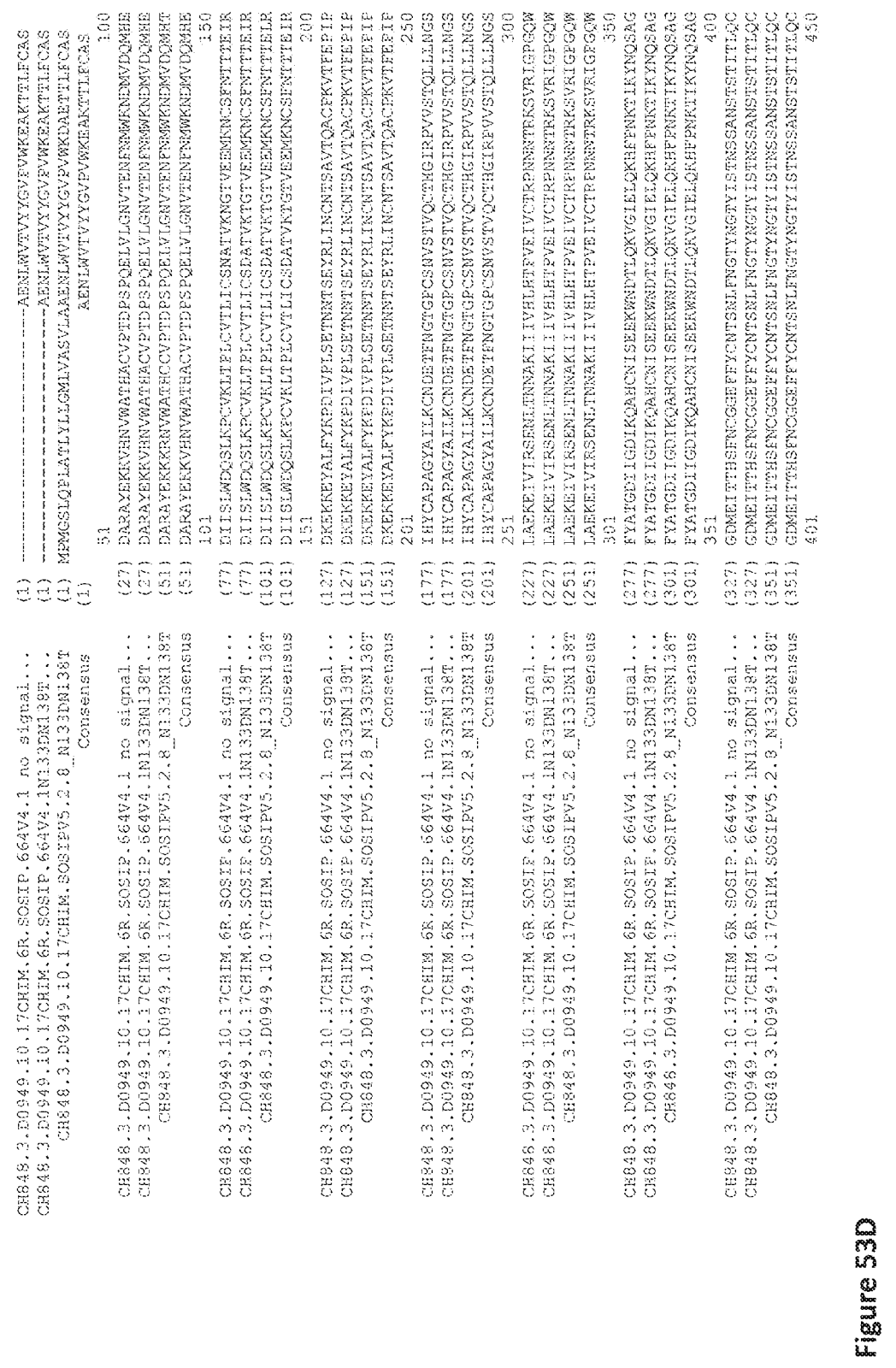

```
CH848.3.D0949.10.17CHIM.6R.SOSIP.664V4.1 no signal...   (1) -------------------------AENLWVTVYYGVPVWKEAKTTLFCAS
CH848.3.D0949.10.17CHIM.6R.SOSIP.664V4.1N133DN138T...   (1) -------------------------AENLWVTVYYGVPVWKEAKTTLFCAS
    CH848.3.D0949.10.17CHIM.SOSIPV5.2.8_N133DN138T   (1) MPMGSLQPLATLYLLGMLVASVLAAENLWVTVYYGVPVWKDAETTLFCAS
                                          Consensus   (1)                          AENLWVTVYYGVPVWKEAKTTLFCAS
                                                         51                                               100
CH848.3.D0949.10.17CHIM.6R.SOSIP.664V4.1 no signal...  (27) DARAYEKKVHNVWATHACVPTDPSPQELVLGNVTENFNMWKNDMVDQMHE
CH848.3.D0949.10.17CHIM.6R.SOSIP.664V4.1N133DN138T...  (27) DARAYEKKVHNVWATHACVPTDPSPQELVLGNVTENFNMWKNDMVDQMHE
    CH848.3.D0949.10.17CHIM.SOSIPV5.2.8_N133DN138T  (51) DARAYEKKKRNVWATHCCVPTDPSPQELVLGNVTENFNMWKNDMVDQMHT
                                          Consensus  (51) DARAYEKKVHNVWATHACVPTDPSPQELVLGNVTENFNMWKNDMVDQMHE
                                                         101                                              150
CH848.3.D0949.10.17CHIM.6R.SOSIP.664V4.1 no signal...  (77) DIISLWDQSLKPCVKLTPLCVTLICSNATVKNGTVEEMKNCSFNTTTEIR
CH848.3.D0949.10.17CHIM.6R.SOSIP.664V4.1N133DN138T...  (77) DIISLWDQSLKPCVKLTPLCVTLICSDATVKTGTVEEMKNCSFNTTTEIR
    CH848.3.D0949.10.17CHIM.SOSIPV5.2.8_N133DN138T (101) DIISLWDQSLKPCVKLTPLCVTLICSDATVKTGTVEEMKNCSFNTTTELR
                                          Consensus (101) DIISLWDQSLKPCVKLTPLCVTLICSDATVKTGTVEEMKNCSFNTTTEIR
                                                         151                                              200
CH848.3.D0949.10.17CHIM.6R.SOSIP.664V4.1 no signal... (127) DKEKKEYALFYKPDIVPLSETNNTSEYRLINCNTSAVTQACPKVTFEPIP
CH848.3.D0949.10.17CHIM.6R.SOSIP.664V4.1N133DN138T... (127) DKEKKEYALFYKPDIVPLSETNNTSEYRLINCNTSAVTQACPKVTFEPIP
    CH848.3.D0949.10.17CHIM.SOSIPV5.2.8_N133DN138T (151) DKEKKEYALFYKPDIVPLSETNNTSEYRLINCNTSAVTQACPKVTFEPIP
                                          Consensus (151) DKEKKEYALFYKPDIVPLSETNNTSEYRLINCNTSAVTQACPKVTFEPIP
                                                         201                                              250
CH848.3.D0949.10.17CHIM.6R.SOSIP.664V4.1 no signal... (177) IHYCAPAGYAILKCNDETFNGTGPCSNVSTVQCTHGIRPVVSTQLLLNGS
CH848.3.D0949.10.17CHIM.6R.SOSIP.664V4.1N133DN138T... (177) IHYCAPAGYAILKCNDETFNGTGPCSNVSTVQCTHGIRPVVSTQLLLNGS
    CH848.3.D0949.10.17CHIM.SOSIPV5.2.8_N133DN138T (201) IHYCAPAGYAILKCNDETFNGTGPCSNVSTVQCTHGIRPVVSTQLLLNGS
                                          Consensus (201) IHYCAPAGYAILKCNDETFNGTGPCSNVSTVQCTHGIRPVVSTQLLLNGS
                                                         251                                              300
CH848.3.D0949.10.17CHIM.6R.SOSIP.664V4.1 no signal... (227) LAEKEIVIRSENLTNNAKIIIVHLHTPVEIVCTRPNNNTRKSVRIGPGQW
CH848.3.D0949.10.17CHIM.6R.SOSIP.664V4.1N133DN138T... (227) LAEKEIVIRSENLTNNAKIIIVHLHTPVEIVCTRPNNNTRKSVRIGPGQW
    CH848.3.D0949.10.17CHIM.SOSIPV5.2.8_N133DN138T (251) LAEKEIVIRSENLTNNAKIIIVHLHTPVEIVCTRPNNNTRKSVRIGPGQW
                                          Consensus (251) LAEKEIVIRSENLTNNAKIIIVHLHTPVEIVCTRPNNNTRKSVRIGPGQW
                                                         301                                              350
CH848.3.D0949.10.17CHIM.6R.SOSIP.664V4.1 no signal... (277) FYATGDIIGDIKQAHCNISEEKWNDTLQKVGIELQKHFPNKTIKYNQSAG
CH848.3.D0949.10.17CHIM.6R.SOSIP.664V4.1N133DN138T... (277) FYATGDIIGDIKQAHCNISEEKWNDTLQKVGIELQKHFPNKTIKYNQSAG
    CH848.3.D0949.10.17CHIM.SOSIPV5.2.8_N133DN138T (301) FYATGDIIGDIKQAHCNISEEKWNDTLQKVGIELQKHFPNKTIKYNQSAG
                                          Consensus (301) FYATGDIIGDIKQAHCNISEEKWNDTLQKVGIELQKHFPNKTIKYNQSAG
                                                         351                                              400
CH848.3.D0949.10.17CHIM.6R.SOSIP.664V4.1 no signal... (327) GDMEITTHSFNCGGEFFYCNTSNLFNGTYNGTYISTNSSANSTSTITLQC
CH848.3.D0949.10.17CHIM.6R.SOSIP.664V4.1N133DN138T... (327) GDMEITTHSFNCGGEFFYCNTSNLFNGTYNGTYISTNSSANSTSTITLQC
    CH848.3.D0949.10.17CHIM.SOSIPV5.2.8_N133DN138T (351) GDMEITTHSFNCGGEFFYCNTSNLFNGTYNGTYISTNSSANSTSTITLQC
                                          Consensus (351) GDMEITTHSFNCGGEFFYCNTSNLFNGTYNGTYISTNSSANSTSTITLQC
                                                         401                                              450
```

Figure 53D

```
CH848.3.D0949.10.17CHIM.6R.SOSIP.664V4.1 no signal...  (377) RIKQIINMWQGVGRAMYAPPIAGNITCRSNITGLLLTRDGGTNSNETETF
CH848.3.D0949.10.17CHIM.6R.SOSIP.664V4.1N133DN138T...  (377) RIKQIINMWQGVGRAMYAPPIAGNITCRSNITGLLLTRDGGTNSNETETF
        CH848.3.D0949.10.17CHIM.SOSIPV5.2.8_N133DN138T  (401) RIKQIINMWQRVGQAMYAPPIAGNITCRSNITGLLLTRDGGTNSNETETF
                                             Consensus  (401) RIKQIINMWQGVGRAMYAPPIAGNITCRSNITGLLLTRDGGTNSNETETF
                                                            451                                              500
CH848.3.D0949.10.17CHIM.6R.SOSIP.664V4.1 no signal...  (427) RPAGGDMRDNWRSELYKYKVVKIEPLGVAPTRCKRRVVGRRRRRRAVGIG
CH848.3.D0949.10.17CHIM.6R.SOSIP.664V4.1N133DN138T...  (427) RPAGGDMRDNWRSELYKYKVVKIEPLGVAPTRCKRRVVGRRRRRRAVGIG
        CH848.3.D0949.10.17CHIM.SOSIPV5.2.8_N133DN138T  (451) RPAGGDMRDNWRSELYKYKVVKIEPLGVAPTRCKRRVVGRRRRRRAVGIG
                                             Consensus  (451) RPAGGDMRDNWRSELYKYKVVKIEPLGVAPTRCKRRVVGRRRRRRAVGIG
                                                            501                                              550
CH848.3.D0949.10.17CHIM.6R.SOSIP.664V4.1 no signal...  (477) AVFLGFLGAAGSTMGAASMTLTVQARNLLSGIVQQQSNLLRAPEAQQHLL
CH848.3.D0949.10.17CHIM.6R.SOSIP.664V4.1N133DN138T...  (477) AVFLGFLGAAGSTMGAASMTLTVQARNLLSGIVQQQSNLLRAPEAQQHLL
        CH848.3.D0949.10.17CHIM.SOSIPV5.2.8_N133DN138T  (501) AVFLGFLGAAGSTMGAASMTLTVQARNLLSGIVQQQSNLLRAPECQQHLL
                                             Consensus  (501) AVFLGFLGAAGSTMGAASMTLTVQARNLLSGIVQQQSNLLRAPEAQQHLL
                                                            551                                              600
CH848.3.D0949.10.17CHIM.6R.SOSIP.664V4.1 no signal...  (527) KLTVWGIKQLQARVLAVERYLRDQQLLGIWGCSGKLICCTNVPWNSSWSN
CH848.3.D0949.10.17CHIM.6R.SOSIP.664V4.1N133DN138T...  (527) KLTVWGIKQLQARVLAVERYLRDQQLLGIWGCSGKLICCTNVPWNSSWSN
        CH848.3.D0949.10.17CHIM.SOSIPV5.2.8_N133DN138T  (551) KLTVWGIKQLQARVLAVERYLRDQQLLGIWGCSGKLICCTNVPWNSSWSN
                                             Consensus  (551) KLTVWGIKQLQARVLAVERYLRDQQLLGIWGCSGKLICCTNVPWNSSWSN
                                                            601                                              650
CH848.3.D0949.10.17CHIM.6R.SOSIP.664V4.1 no signal...  (577) RNLSEIWDNMTWLQWDKEISNYTQIIYGLLEESQNQQEKNEQDLLALD--
CH848.3.D0949.10.17CHIM.6R.SOSIP.664V4.1N133DN138T...  (577) RNLSEIWDNMTWLQWDKEISNYTQIIYGLLEESQNQQEKNEQDLLALD--
        CH848.3.D0949.10.17CHIM.SOSIPV5.2.8_N133DN138T  (601) RNLSEIWDNMTWLQWDKEISNYTQIIYGLLEESQNQQEKNEQDLLALD--
                                             Consensus  (601) RNLSEIWDNMTWLQWDKEISNYTQIIYGLLEESQNQQEKNEQDLLALD
```

Figure 53D continued

1. CH848.3.D949.10.17_N133DN138T as a first generation .664 SOSIP

>CH848.3.D949.10.17_N133DN138T<u>chimeric</u>SOSIP

MGSLQPLATLYLLGMLVASVLAAENLWVTVYYGVPVWKEAKTTLFCASDARAYEKEVHNVWA
THACVPTDPSPQELVLGNVTENFNMWKNDMVDQMHEDIISLWDQSLKPCVKLTPLCVTLICS
DATVKTGTVEEMKNCSFNTTTEIRDKEKKEYALFYKPDIVPLSETNNTSEYRLINCNTSAIT
QACPKVTFEPIPIHYCAPAGYAILKCNDETFNGTGPCSNVSTVQCTHGIRPVVSTQLLLNGS
LAEKEIVIRSENLTNNAKIIIVHLHTPVEIVCTRPNNNTRKSVRIGPGQTFYATGDIIGDIK
QAHCNISEEKWNDTLQKVGIELQKHFPNKTIKYNQSAGGDMEITTHSFNCGGEFFYCNTSNL
FNGTYNGTYISTNSSANSTSTITLQCRIKQIINMWQGVGRAMYAPPIAGNITCRSNITGLLL
TRDGGTNSNETETFRPAGGDMRDNWRSELYKYKVVKIEPLGVAPTRCKRRVVGRRRRRRAVG
IGAVFLGFLGAAGSTMGAASMTLTVQARNLLSGIVQQQSNLLRAPEAQQHLLKLTVWGIKQL
QARVLAVERYLRDQQLLGIWGCSGKLICCTNVPWNSSWSNRNLSEIWDNMTWLQWDKEISNY
TQIIYGLLEESQNQQEKNEQDLLALD**

>CH848.3.D949.10.17_N133DN138TSOSIP.664

MGSLQPLATLYLLGMLVASVLAKGKLWVTVYYGVPVWKEAKTTLFCASDARAYEKEVHNVWA
THACVPTDPSPQELVLGNVTENFNMWKNDMVDQMHEDIISLWDQSLKPCVKLTPLCVTLICS
DATVKTGTVEEMKNCSFNTTTEIRDKEKKEYALFYKPDIVPLSETNNTSEYRLINCNTSAIT
QACPKVTFEPIPIHYCAPAGYAILKCNDETFNGTGPCSNVSTVQCTHGIRPVVSTQLLLNGS
LAEKEIVIRSENLTNNAKIIIVHLHTPVEIVCTRPNNNTRKSVRIGPGQTFYATGDIIGDIK
QAHCNISEEKWNDTLQKVGIELQKHFPNKTIKYNQSAGGDMEITTHSFNCGGEFFYCNTSNL
FNGTYNGTYISTNSSANSTSTITLQCRIKQIINMWQGVGRAMYAPPIAGNITCRSNITGLLL
TRDGGTNSNETETFRPAGGDMRDNWRSELYKYKVVEIQPLGIAPTGCKRRVVERRRRRRAAG
LGALFLGFLGAAGSTMGAASITLTVQARQLLSGIVQQQSNLLRAPEAQQHMLQLTVWGIKQL
QARVLALERYLKDQQLLGMWGCSGKLICCTNVPWNTSWSNKSETDIWDNMTWMQWEREISNY
TETIYKLLEDSQNQQERNEQDLLALD**

Figure 54A

2. CH848.3.D949.10.17_N133DN138T plus the disulfide that blocks CD4 induced conformational changes

>CH848.3.D949.10.17_N133DN138TchimericDS.SOSIP

MGSLQPLATLYLLGMLVASVLAAENLWVTVYYGVPVWKEAKTTLFCASDARAYEKEVHNVWA
THACVPTDPSPQELVLGNVTENFNMWKNDMVDQMHEDIISLWDQSLKPCVKLTPLCVTLICS
DATVKTGTVEEMKNCSFNTTTEIRDKEKKEYALFYKPDIVPLSETNNTSEYRLINCNTSACT
QACPKVTFEPIPIHYCAPAGYAILKCNDETFNGTGPCSNVSTVQCTHGIRPVVSTQLLLNGS
LAEKEIVIRSENLTNNAKIIIVHLHTPVEIVCTRPNNNTRKSVRIGPGQTFYATGDIIGDIK
QAHCNISEEKWNDTLQKVGIELQKHFPNKTIKYNQSAGGDMEITTHSFNCGGEFFYCNTSNL
FNGTYNGTYISTNSSANSTSTITLQCRIKQIINMWQGVGRCMYAPPIAGNITCRSNITGLLL
TRDGGTNSNETETFRPAGGDMRDNWRSELYKYKVVKIEPLGVAPTRCKRRVVGRRRRRRAVG
IGAVFLGFLGAAGSTMGAASMTLTVQARNLLSGIVQQQSNLLRAPEAQQHLLKLTVWGIKQL
QARVLAVERYLRDQQLLGIWGCSGKLICCTNVPWNSSWSNRNLSEIWDNMTWLQWDKEISNY
TQIIYGLLEESQNQQEKNEQDLLALD**

>CH848.3.D949.10.17_N133DN138TDS.SOSIP

MGSLQPLATLYLLGMLVASVLAKGKLWVTVYYGVPVWKEAKTTLFCASDARAYEKEVHNVWA
THACVPTDPSPQELVLGNVTENFNMWKNDMVDQMHEDIISLWDQSLKPCVKLTPLCVTLICS
DATVKTGTVEEMKNCSFNTTTEIRDKEKKEYALFYKPDIVPLSETNNTSEYRLINCNTSACT
QACPKVTFEPIPIHYCAPAGYAILKCNDETFNGTGPCSNVSTVQCTHGIRPVVSTQLLLNGS
LAEKEIVIRSENLTNNAKIIIVHLHTPVEIVCTRPNNNTRKSVRIGPGQTFYATGDIIGDIK
QAHCNISEEKWNDTLQKVGIELQKHFPNKTIKYNQSAGGDMEITTHSFNCGGEFFYCNTSNL
FNGTYNGTYISTNSSANSTSTITLQCRIKQIINMWQGVGRCMYAPPIAGNITCRSNITGLLL
TRDGGTNSNETETFRPAGGDMRDNWRSELYKYKVVEIQPLGIAPTGCKRRVVERRRRRRAAG
LGALFLGFLGAAGSTMGAASITLTVQARQLLSGIVQQQSNLLRAPEAQQHMLQLTVWGIKQL
QARVLALERYLKDQQLLGMWGCSGKLICCTNVPWNTSWSNKSETDIWDNMTWMQWEREISNY
TETIYKLLEDSQNQQERNEQDLLALD**

Figure 54B

3. CH848.3.D949.10.17_N133DN138T plus the disulfide that blocks CD4 induced conformational changes and Rich Wyatt's .8 mutations: D47, E49, K65, T106, L165, R429, Q432, R500

>CH848.3.D949.10.17_N133DN138TchimericTD8.DS.SOSIP

MGSLQPLATLYLLGMLVASVLAAENLWVTVYYGVPVWKDAETTLFCASDARAYEKEKHNVWATHACVPTDPSPQELVLGNVTENFNMWKNDMVDQM
HTDIISLWDQSLKPCVKLTPLCVTLICSDATVKTGTVEEMKNCSFNTTTELRDKEKKEYALFYKPDIVPLSETNNTSEYRLINCNTSACTQACPKV
TFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTR
KSVRIGPGQTFYATGDIIGDIKQAHCNISEEKWNDTLQKVGIELQKHFPNKTIKYNQSAGGDMEITTHSFNCGGEFFYCNTSNLFNGTYNGTYIST
NSSANSTSTITLQCRIKQIINMWQRVGQCMYAPPIAGNITCRSNITGLLLTRDGGTNSNETETFRPAGGDMRDNWRSELYKYKVVKIEPLGVAPTR
CKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLG
IWGCSGKLICCTNVPWNSSWSNRNLSEIWDNMTWLQWDKEISNYTQIIYGLLEESQNQQEKNEQDLLALD**

>CH848.3.D949.10.17_N133DN138TTD8.DS.SOSIP.664

MGSLQPLATLYLLGMLVASVLAKGKLWVTVYYGVPVWKDAETTLFCASDARAYEKEKHNVWATHACVPTDPSPQELVLGNVTENFNMWKNDMVDQM
HTDIISLWDQSLKPCVKLTPLCVTLICSDATVKTGTVEEMKNCSFNTTTELRDKEKKEYALFYKPDIVPLSETNNTSEYRLINCNTSACTQACPKV
TFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTR
KSVRIGPGQTFYATGDIIGDIKQAHCNISEEKWNDTLQKVGIELQKHFPNKTIKYNQSAGGDMEITTHSFNCGGEFFYCNTSNLFNGTYNGTYIST
NSSANSTSTITLQCRIKQIINMWQRVGQCMYAPPIAGNITCRSNITGLLLTRDGGTNSNETETFRPAGGDMRDNWRSELYKYKVVEIQPLGIAPTR
CKRRVVERRRRRRAAGLGALFLGFLGAAGSTMGAASITLTVQARQLLSGIVQQQSNLLRAPEAQQHMLQLTVWGIKQLQARVLALERYLKDQQLLG
MWGCSGKLICCTNVPWNTSWSNKSETDIWDNMTWMQWEREISNYTETIYKLLEDSQNQQERNEQDLLALD**

Figure 54C

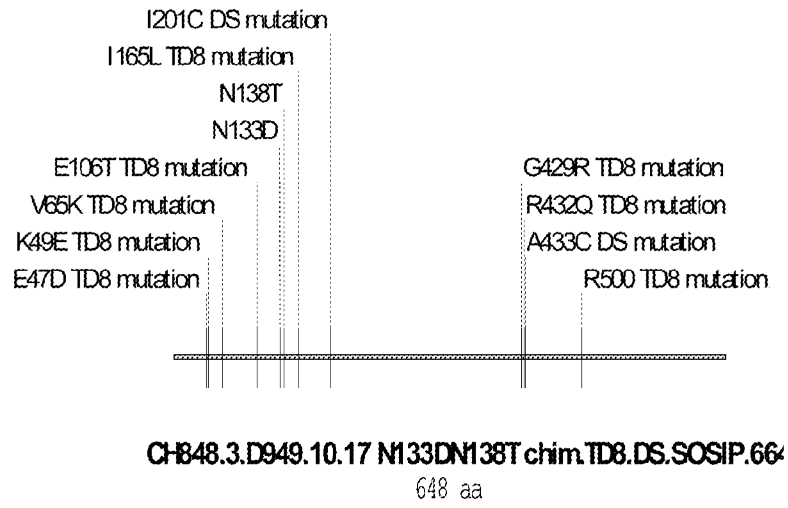

Figure 54D

```
                                         E47D TD8 mutation    V65K TD8 mutation
                                         ~                    ~
                                            K49E TD8 mutation                                                E106T TD8 mutation
                                            ~                                                                ~
  1  MGSLQPLATL YLLGMLVASV LAAENLWVTV YYGVPVWKDA ETTLFCASDA RAYEKEKHNV WATHACVPTD PSPQELVLGN VTENFNMWKN DMVDQMHTDI
                               N138T
                               ~~
                          N133D                 I165L TD8 mutation                                I201C DS mutation
                          ~                     ~                                                 ~
101  ISLWDQSLKP CVKLTPLCVT LICSDATVKT GTVEEMKNCS FNTTTELRDK EKKEYALFYK PDIVPLSETN NTSEYRLINC NTSACTQACP KVTFEPIPIH
201  YCAPAGYAIL KCNDETFNGT GPCSNVSTVQ CTHGIRPVVS TQLLLNGSLA EKEIVIRSEN LTNNAKIIIV HLHTPVEIVC TRPNNNTRKS VRIGPGQTFY
301  ATGDIIGDIK QAHCNISEEK WNDTLQKVGI ELQKHFPNKT IKYNQSAGGD MEITTHSFNC GGEFFYCNTS NLFNGTYNGT YISTNSSANS TSTITLQCRI
                 A433C DS mutation
                 ~
                R432Q TD8 mutation
                ~
           G429R TD8 mutation                                                               R500 TD8 mutation
           ~                                                                                ~~
401  KQIINMWQRV GQCMYAPPIA GNITCRSNIT GLLLTRDGGT NSNETETFRP AGGDMRDNWR SELYKYKVVK IEPLGVAPTR CKRRVVGRRR RRRAVGIGAV
501  FLGFLGAAGS TMGAASMTLT VQARNLLSGI VQQQSNLLRA PEAQQHLLKL TVWGIKQLQA RVLAVERYLR DQQLLGIWGC SGKLICCTNV PWNSSWSNRN
601  LSEIWDNMTW LQWDKEISNY TQIIYGLLEE SQNQQEKNEQ DLLALD**
```

Figure 54E

```
                                                              1                                                 50
CH848.3.D949.10.17_N133DN138TchimericDS.SOSIP           (1)   MGSLQPLATLYLLGMLVASVLAAENLWVTVYYGVPVWKEAKTTLFCASDA
CH848.3.D949.10.17_N133DN138TchimericSOSIP              (1)   MGSLQPLATLYLLGMLVASVLAAENLWVTVYYGVPVWKEAKTTLFCASDA
CH848.3.D949.10.17_N133DN138TchimericTD8.DS.SOSIP       (1)   MGSLQPLATLYLLGMLVASVLAAENLWVTVYYGVPVWKDAETTLFCASDA
CH848.3.D949.10.17_N133DN138TDS.SOSIP                   (1)   MGSLQPLATLYLLGMLVASVLAKGKLWVTVYYGVPVWKEAKTTLFCASDA
CH848.3.D949.10.17_N133DN138TSOSIP.664                  (1)   MGSLQPLATLYLLGMLVASVLAKGKLWVTVYYGVPVWKEAKTTLFCASDA
CH848.3.D949.10.17_N133DN138TTD8.DS.SOSIP.664           (1)   MGSLQPLATLYLLGMLVASVLAKGKLWVTVYYGVPVWKDAETTLFCASDA
Consensus                                               (1)   MGSLQPLATLYLLGMLVASVLAKGNLWVTVYYGVPVWKEAKTTLFCASDA
                                                              51                                               100
CH848.3.D949.10.17_N133DN138TchimericDS.SOSIP          (51)   RAYEKEVHNVWATHACVPTDPSPQELVLGNVTENFNMWKNDMVDQMHEDI
CH848.3.D949.10.17_N133DN138TchimericSOSIP             (51)   RAYEKEVHNVWATHACVPTDPSPQELVLGNVTENFNMWKNDMVDQMHEDI
CH848.3.D949.10.17_N133DN138TchimericTD8.DS.SOSIP      (51)   RAYEKEKHNVWATHACVPTDPSPQELVLGNVTENFNMWKNDMVDQMHTDI
CH848.3.D949.10.17_N133DN138TDS.SOSIP                  (51)   RAYEKEVHNVWATHACVPTDPSPQELVLGNVTENFNMWKNDMVDQMHEDI
CH848.3.D949.10.17_N133DN138TSOSIP.664                 (51)   RAYEKEVHNVWATHACVPTDPSPQELVLGNVTENFNMWKNDMVDQMHEDI
CH848.3.D949.10.17_N133DN138TTD8.DS.SOSIP.664          (51)   RAYEKEKHNVWATHACVPTDPSPQELVLGNVTENFNMWKNDMVDQMHTDI
Consensus                                              (51)   RAYEKEVHNVWATHACVPTDPSPQELVLGNVTENFNMWKNDMVDQMHEDI
                                                              101                                              150
CH848.3.D949.10.17_N133DN138TchimericDS.SOSIP         (101)   ISLWDQSLKPCVKLTPLCVTLICSDATVKIGTVEEMKNCSFNITTEIRDK
CH848.3.D949.10.17_N133DN138TchimericSOSIP            (101)   ISLWDQSLKPCVKLTPLCVTLICSDATVKIGTVEEMKNCSFNITTEIRDK
CH848.3.D949.10.17_N133DN138TchimericTD8.DS.SOSIP     (101)   ISLWDQSLKPCVKLTPLCVTLICSDATVKTGTVEEMKNCSFNTTTELRDK
CH848.3.D949.10.17_N133DN138TDS.SOSIP                 (101)   ISLWDQSLKPCVKLTPLCVTLICSDATVKTGTVEEMKNCSFNTTTEIRDK
CH848.3.D949.10.17_N133DN138TSOSIP.664                (101)   ISLWDQSLKPCVKLTPLCVTLICSDATVKTGTVEEMKNCSFNTTTEIRDK
CH848.3.D949.10.17_N133DN138TTD8.DS.SOSIP.664         (101)   ISLWDQSLKPCVKLTPLCVTLICSDATVKTGTVEEMKNCSFNTTTELRDK
Consensus                                             (101)   ISLWDQSLKPCVKLTPLCVTLICSDATVKTGTVEEMKNCSFNTTTEIRDK
                                                              151                                              200
CH848.3.D949.10.17_N133DN138TchimericDS.SOSIP         (151)   EKKEYALFYKPDIVPLSETNNTSEYRLINCNTSACTQACPKVTFEPIPIH
CH848.3.D949.10.17_N133DN138TchimericSOSIP            (151)   EKKEYALFYKPDIVPLSETNNTSEYRLINCNTSAITQACPKVTFEPIPIH
CH848.3.D949.10.17_N133DN138TchimericTD8.DS.SOSIP     (151)   EKKEYALFYKPDIVPLSETNNTSEYRLINCNTSACTQACPKVTFEPIPIH
CH848.3.D949.10.17_N133DN138TDS.SOSIP                 (151)   EKKEYALFYKPDIVPLSETNNTSEYRLINCNTSACTQACPKVTFEPIPIH
CH848.3.D949.10.17_N133DN138TSOSIP.664                (151)   EKKEYALFYKPDIVPLSETNNTSEYRLINCNTSAITQACPKVTFEPIPIH
CH848.3.D949.10.17_N133DN138TTD8.DS.SOSIP.664         (151)   EKKEYALFYKPDIVPLSETNNTSEYRLINCNTSACTQACPKVTFEPIPIH
Consensus                                             (151)   EKKEYALFYKPDIVPLSETNNTSEYRLINCNTSACTQACPKVTFEPIPIH
                                                              201                                              250
```

Figure 54F

| | | |
|---|---|---|
| CH848.3.D949.10.17_N133DN138TchimericDS.SOSIP | (201) | YCAPAGYAILKCNDETFNGTGPCSNVSTVQCTHGIRPVVSTQLLLNGSLA |
| CH848.3.D949.10.17_N133DN138TchimericSOSIP | (201) | YCAPAGYAILKCNDETFNGTGPCSNVSTVQCTHGIRPVVSTQLLLNGSLA |
| CH848.3.D949.10.17_N133DN138TchimericTD8.DS.SOSIP | (201) | YCAPAGYAILKCNDETFNGTGPCSNVSTVQCTHGIRPVVSTQLLLNGSLA |
| CH848.3.D949.10.17_N133DN138TDS.SOSIP | (201) | YCAPAGYAILKCNDETFNGTGPCSNVSTVQCTHGIRPVVSTQLLLNGSLA |
| CH848.3.D949.10.17_N133DN138TSOSIP.664 | (201) | YCAPAGYAILKCNDETFNGTGPCSNVSTVQCTHGIRPVVSTQLLLNGSLA |
| CH848.3.D949.10.17_N133DN138TTD8.DS.SOSIP.664 | (201) | YCAPAGYAILKCNDETFNGTGPCSNVSTVQCTHGIRPVVSTQLLLNGSLA |
| Consensus | (201) | YCAPAGYAILKCNDETFNGTGPCSNVSTVQCTHGIRPVVSTQLLLNGSLA |
| | | 251 300 |
| CH848.3.D949.10.17_N133DN138TchimericDS.SOSIP | (251) | EKEIVIRSENLTNNAKIIIVHLHTPVEIVCTRPNNNTRKSVRIGPGQTFY |
| CH848.3.D949.10.17_N133DN138TchimericSOSIP | (251) | EKEIVIRSENLTNNAKIIIVHLHTPVEIVCTRPNNNTRKSVRIGPGQTFY |
| CH848.3.D949.10.17_N133DN138TchimericTD8.DS.SOSIP | (251) | EKEIVIRSENLTNNAKIIIVHLHTPVEIVCTRPNNNTRKSVRIGPGQTFY |
| CH848.3.D949.10.17_N133DN138TDS.SOSIP | (251) | EKEIVIRSENLTNNAKIIIVHLHTPVEIVCTRPNNNTRKSVRIGPGQTFY |
| CH848.3.D949.10.17_N133DN138TSOSIP.664 | (251) | EKEIVIRSENLTNNAKIIIVHLHTPVEIVCTRPNNNTRKSVRIGPGQTFY |
| CH848.3.D949.10.17_N133DN138TTD8.DS.SOSIP.664 | (251) | EKEIVIRSENLTNNAKIIIVHLHTPVEIVCTRPNNNTRKSVRIGPGQTFY |
| Consensus | (251) | EKEIVIRSENLTNNAKIIIVHLHTPVEIVCTRPNNNTRKSVRIGPGQTFY |
| | | 301 350 |
| CH848.3.D949.10.17_N133DN138TchimericDS.SOSIP | (301) | ATGDIIGDIKQAHCNISEEKWNDTLQKVGIELQKHFPNKTIKYNQSAGGD |
| CH848.3.D949.10.17_N133DN138TchimericSOSIP | (301) | ATGDIIGDIKQAHCNISEEKWNDTLQKVGIELQKHFPNKTIKYNQSAGGD |
| CH848.3.D949.10.17_N133DN138TchimericTD8.DS.SOSIP | (301) | ATGDIIGDIKQAHCNISEEKWNDTLQKVGIELQKHFPNKTIKYNQSAGGD |
| CH848.3.D949.10.17_N133DN138TDS.SOSIP | (301) | ATGDIIGDIKQAHCNISEEKWNDTLQKVGIELQKHFPNKTIKYNQSAGGD |
| CH848.3.D949.10.17_N133DN138TSOSIP.664 | (301) | ATGDIIGDIKQAHCNISEEKWNDTLQKVGIELQKHFPNKTIKYNQSAGGD |
| CH848.3.D949.10.17_N133DN138TTD8.DS.SOSIP.664 | (301) | ATGDIIGDIKQAHCNISEEKWNDTLQKVGIELQKHFPNKTIKYNQSAGGD |
| Consensus | (301) | ATGDIIGDIKQAHCNISEEKWNDTLQKVGIELQKHFPNKTIKYNQSAGGD |
| | | 351 400 |
| CH848.3.D949.10.17_N133DN138TchimericDS.SOSIP | (351) | MEITTHSFNCGGEFFYCNTSNLFNGTYNGTYISTNSSANSTSTITLQCRI |
| CH848.3.D949.10.17_N133DN138TchimericSOSIP | (351) | MEITTHSFNCGGEFFYCNTSNLFNGTYNGTYISTNSSANSTSTITLQCRI |
| CH848.3.D949.10.17_N133DN138TchimericTD8.DS.SOSIP | (351) | MEITTHSFNCGGEFFYCNTSNLFNGTYNGTYISTNSSANSTSTITLQCRI |
| CH848.3.D949.10.17_N133DN138TDS.SOSIP | (351) | MEITTHSFNCGGEFFYCNTSNLFNGTYNGTYISTNSSANSTSTITLQCRI |
| CH848.3.D949.10.17_N133DN138TSOSIP.664 | (351) | MEITTHSFNCGGEFFYCNTSNLFNGTYNGTYISTNSSANSTSTITLQCRI |
| CH848.3.D949.10.17_N133DN138TTD8.DS.SOSIP.664 | (351) | MEITTHSFNCGGEFFYCNTSNLFNGTYNGTYISTNSSANSTSTITLQCRI |
| Consensus | (351) | MEITTHSFNCGGEFFYCNTSNLFNGTYNGTYISTNSSANSTSTITLQCRI |
| | | 401 450 |

Figure 54F continued

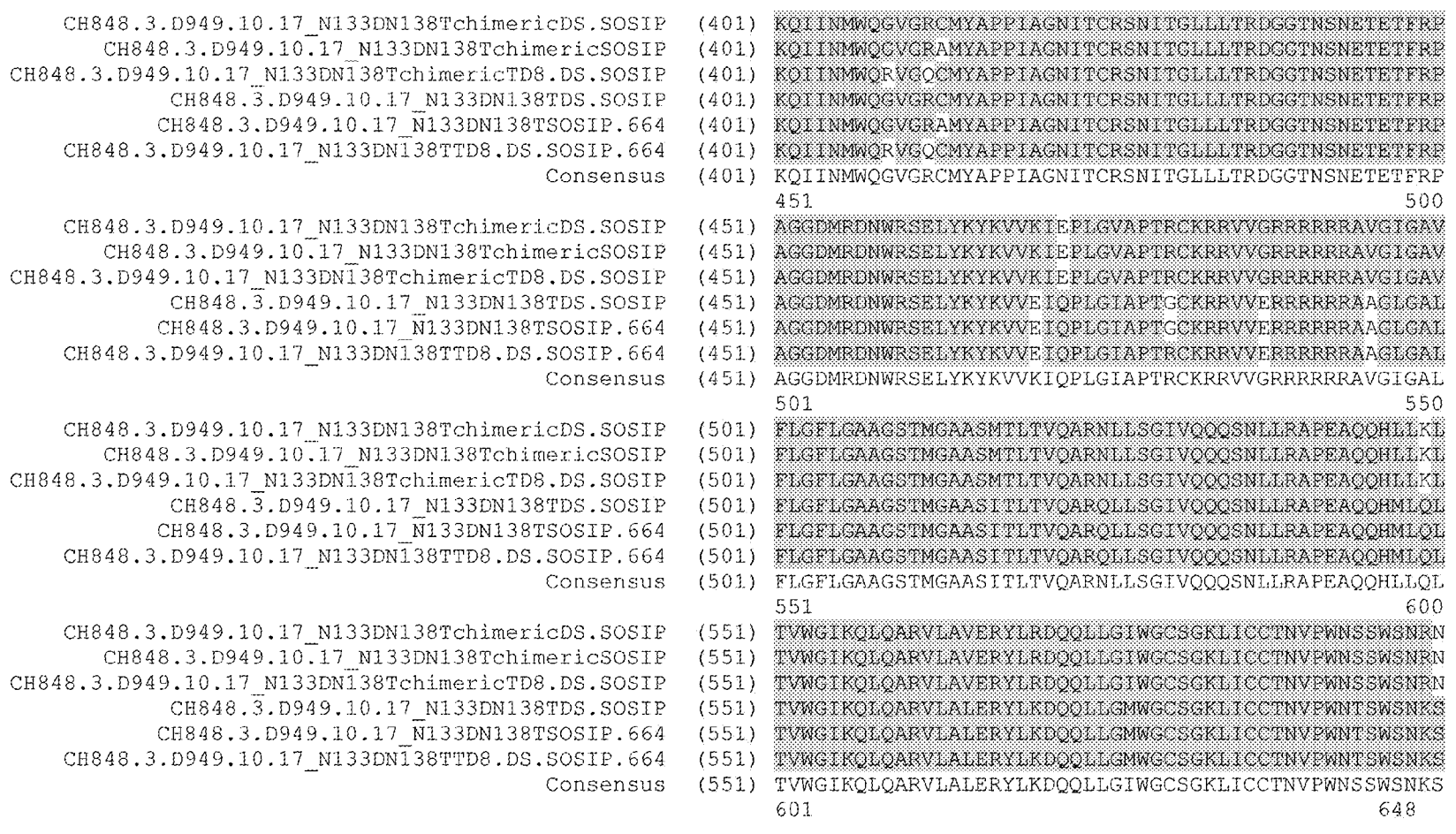

```
  CH848.3.D949.10.17_N133DN138TchimericDS.SOSIP  (401) KQIINMWQGVGRCMYAPPIAGNITCRSNITGLLLTRDGGTNSNETETFRP
    CH848.3.D949.10.17_N133DN138TchimericSOSIP  (401) KQIINMWQGVGRAMYAPPIAGNITCRSNITGLLLTRDGGTNSNETETFRP
CH848.3.D949.10.17_N133DN138TchimericTD8.DS.SOSIP  (401) KQIINMWQRVGQCMYAPPIAGNITCRSNITGLLLTRDGGTNSNETETFRP
         CH848.3.D949.10.17_N133DN138TDS.SOSIP  (401) KQIINMWQGVGRCMYAPPIAGNITCRSNITGLLLTRDGGTNSNETETFRP
        CH848.3.D949.10.17_N133DN138TSOSIP.664  (401) KQIINMWQGVGRAMYAPPIAGNITCRSNITGLLLTRDGGTNSNETETFRP
  CH848.3.D949.10.17_N133DN138TTD8.DS.SOSIP.664  (401) KQIINMWQRVGQCMYAPPIAGNITCRSNITGLLLTRDGGTNSNETETFRP
                                     Consensus  (401) KQIINMWQGVGRCMYAPPIAGNITCRSNITGLLLTRDGGTNSNETETFRP
                                                      451                                            500
  CH848.3.D949.10.17_N133DN138TchimericDS.SOSIP  (451) AGGDMRDNWRSELYKYKVVKIEPLGVAPTRCKRRVVGRRRRRRAVGIGAV
    CH848.3.D949.10.17_N133DN138TchimericSOSIP  (451) AGGDMRDNWRSELYKYKVVKIEPLGVAPTRCKRRVVGRRRRRRAVGIGAV
CH848.3.D949.10.17_N133DN138TchimericTD8.DS.SOSIP  (451) AGGDMRDNWRSELYKYKVVKIEPLGVAPTRCKRRVVGRRRRRRAVGIGAV
         CH848.3.D949.10.17_N133DN138TDS.SOSIP  (451) AGGDMRDNWRSELYKYKVVEIQPLGIAPTGCKRRVVERRRRRRAAGLGAL
        CH848.3.D949.10.17_N133DN138TSOSIP.664  (451) AGGDMRDNWRSELYKYKVVEIQPLGIAPTGCKRRVVERRRRRRAAGLGAL
  CH848.3.D949.10.17_N133DN138TTD8.DS.SOSIP.664  (451) AGGDMRDNWRSELYKYKVVEIQPLGIAPTRCKRRVVERRRRRRAAGLGAL
                                     Consensus  (451) AGGDMRDNWRSELYKYKVVKIQPLGIAPTRCKRRVVGRRRRRRAVGIGAL
                                                      501                                            550
  CH848.3.D949.10.17_N133DN138TchimericDS.SOSIP  (501) FLGFLGAAGSTMGAASMTLTVQARNLLSGIVQQQSNLLRAPEAQQHLLKL
    CH848.3.D949.10.17_N133DN138TchimericSOSIP  (501) FLGFLGAAGSTMGAASMTLTVQARNLLSGIVQQQSNLLRAPEAQQHLLKL
CH848.3.D949.10.17_N133DN138TchimericTD8.DS.SOSIP  (501) FLGFLGAAGSTMGAASMTLTVQARNLLSGIVQQQSNLLRAPEAQQHLLKL
         CH848.3.D949.10.17_N133DN138TDS.SOSIP  (501) FLGFLGAAGSTMGAASITLTVQARQLLSGIVQQQSNLLRAPEAQQHMLQL
        CH848.3.D949.10.17_N133DN138TSOSIP.664  (501) FLGFLGAAGSTMGAASITLTVQARQLLSGIVQQQSNLLRAPEAQQHMLQL
  CH848.3.D949.10.17_N133DN138TTD8.DS.SOSIP.664  (501) FLGFLGAAGSTMGAASITLTVQARQLLSGIVQQQSNLLRAPEAQQHMLQL
                                     Consensus  (501) FLGFLGAAGSTMGAASITLTVQARNLLSGIVQQQSNLLRAPEAQQHLLQL
                                                      551                                            600
  CH848.3.D949.10.17_N133DN138TchimericDS.SOSIP  (551) TVWGIKQLQARVLAVERYLRDQQLLGIWGCSGKLICCTNVPWNSSWSNRN
    CH848.3.D949.10.17_N133DN138TchimericSOSIP  (551) TVWGIKQLQARVLAVERYLRDQQLLGIWGCSGKLICCTNVPWNSSWSNRN
CH848.3.D949.10.17_N133DN138TchimericTD8.DS.SOSIP  (551) TVWGIKQLQARVLAVERYLRDQQLLGIWGCSGKLICCTNVPWNSSWSNRN
         CH848.3.D949.10.17_N133DN138TDS.SOSIP  (551) TVWGIKQLQARVLALERYLKDQQLLGMWGCSGKLICCTNVPWNTSWSNKS
        CH848.3.D949.10.17_N133DN138TSOSIP.664  (551) TVWGIKQLQARVLALERYLKDQQLLGMWGCSGKLICCTNVPWNTSWSNKS
  CH848.3.D949.10.17_N133DN138TTD8.DS.SOSIP.664  (551) TVWGIKQLQARVLALERYLKDQQLLGMWGCSGKLICCTNVPWNTSWSNKS
                                     Consensus  (551) TVWGIKQLQARVLALERYLKDQQLLGIWGCSGKLICCTNVPWNSSWSNKS
                                                      601                                         648
```

Figure 54F continued

```
CH848.3.D949.10.17_N133DN138TchimericDS.SOSIP      (601) LSEIWDNMTWLQWDKEISNYTQIIYGLLEESQNQQEKNEQDLLALD--
CH848.3.D949.10.17_N133DN138TchimericSOSIP         (601) LSEIWDNMTWLQWDKEISNYTQIIYGLLEESQNQQEKNEQDLLALD--
CH848.3.D949.10.17_N133DN138TchimericTD8.DS.SOSIP  (601) LSEIWDNMTWLQWDKEISNYTQIIYGLLEESQNQQEKNEQDLLALD--
CH848.3.D949.10.17_N133DN138TDS.SOSIP              (601) ETDIWDNMTWMQWEREISNYTETIYKLLEDSQNQQERNEQDLLALD--
CH848.3.D949.10.17_N133DN138TSOSIP.664             (601) ETDIWDNMTWMQWEREISNYTETIYKLLEDSQNQQERNEQDLLALD--
CH848.3.D949.10.17_N133DN138TTD8.DS.SOSIP.664      (601) ETDIWDNMTWMQWEREISNYTETIYKLLEDSQNQQERNEQDLLALD--
Consensus                                          (601) LSDIWDNMTWLQWDKEISNYTQTIYKLLEDSQNQQEKNEQDLLALD
```

Figure 54F continued

| Env | CH0848.D0949.10.17 | CH0848.D0949.10.17 N133D/N138T |
|---|---|---|
| V1 length (aa) | 17 aa | 17 aa |
| V1 glycans | N133/N138/N156 | N156 |

| DH270 UCA binding affinity to different forms of CH0848.D0949.10.17 Env | | | |
|---|---|---|---|
| Env | ka (1/Ms) | kd (1/s) | KD (nM) |
| Stabilized SOSIP | 659 | 1.71e-3 | 2,600 |
| Uncleaved gp140 | No binding | No binding | No binding |
| Monomeric gp120 | No binding | No binding | No binding |

| CH0848.D0949.10.17 Env binding by DH270 UCA | | | |
|---|---|---|---|
| **N133 + N138 glycan** | **ka (1/Ms)** | **kd (1/s)** | **Kd (nM)** |
| **Yes** | 659 | 1.71e-3 | **2600** |
| **No** | 4.4e3 | 1.28e-4 | **29.2** |

| Neutralization titer (IC50, µg/mL) | | | |
|---|---|---|---|
| Antibody ID | MuLV | CH0848.3.D949.10.17 | CH0848.3.D949.10.17 N133D N138T |
| DH270 UCA | >50 | >50 | 1.7 |
| DH270.6 | >50 | 0.06 | <0.023 |

Figure 62A

| Neutralization titer (IC50, µg/mL) | | |
|---|---|---|
| Antibody ID | JR-FL | JR-FL N135Q N137Q N141Q |
| DH270 UCA | >50 | >50 |
| DH270.6 | 0.04 | <0.023 |

Negative control virus MuLV titers were >50 µg/mL

Figure 62B

| Neutralization titer (ID50) in TZM-bl assay | | | | |
|---|---|---|---|---|
| Group | Animal ID | Bleed | SVA-MLV | CH0848.3.D949.10.17 N133D/N138T |
| CH0848 N133D N138T SOSIP | DH1 | Pre-immune | <60 | 79 |
| | DH1 | 6x Post-immune | <60 | 21491 |
| | DH2 | Pre-immune | <60 | 105 |
| | DH2 | 6x Post-immune | <60 | 59583 |
| | DH5 | Pre-immune | <60 | 87 |
| | DH5 | 6x Post-immune | <60 | 31330 |
| | DH6 | Pre-immune | <60 | 61 |
| | DH6 | 6x Post-immune | <60 | 126658 |
| | DH7 | Pre-immune | <60 | 79 |
| | DH7 | 6x Post-immune | <60 | 7596 |
| Adjuvant only | DH4 | Pre-immune | <60 | 92 |
| | DH4 | 6x Post-immune | <60 | 87 |
| | DH10 | Pre-immune | <60 | 80 |
| | DH10 | 6x Post-immune | <60 | <60 |
| | DH11 | Pre-immune | <60 | <60 |
| | DH11 | 6x Post-immune | <60 | <60 |

Figure 68

| Neutralization titer (ID50) in TZM-bl assay | | | | | |
|---|---|---|---|---|---|
| Group | Animal ID | Bleed | SVA-MLV | CH0848.3.D949.10.17 N133D/N138T | CH0848.3.D949.10.17 |
| CH0848 N133D N138T SOSIP | DH1 | Pre-immune | <60 | 79 | <60 |
| | DH1 | 6x Post-immune | <60 | 21491 | 815 |
| | DH2 | Pre-immune | <60 | 105 | 68 |
| | DH2 | 6x Post-immune | <60 | 59583 | 252 |
| | DH5 | Pre-immune | <60 | 87 | <60 |
| | DH5 | 6x Post-immune | <60 | 31330 | 1118 |
| | DH6 | Pre-immune | <60 | 61 | <60 |
| | DH6 | 6x Post-immune | <60 | 126658 | 141 |
| | DH7 | Pre-immune | <60 | 79 | <60 |
| | DH7 | 6x Post-immune | <60 | 7596 | 226 |
| Adjuvant only | DH4 | Pre-immune | <60 | 92 | <60 |
| | DH4 | 6x Post-immune | <60 | 87 | <60 |
| | DH10 | Pre-immune | <60 | 80 | <60 |
| | DH10 | 6x Post-immune | <60 | <60 | <60 |
| | DH11 | Pre-immune | <60 | <60 | <60 |
| | DH11 | 6x Post-immune | <60 | <60 | <60 |

Figure 69

```
              295   301                               332 334
JRFL          VEINCTRPNNNTRKSIHIGPGRAFYTTGEIIGDIRQAHCNISRA
D0949.10.17   ...V...........VR....QT..A..D.....K.......EE
D1305.10.19   ...V....GH.....VR....QT..A..D............NES
```

Negative Stain EM 14,069 particles

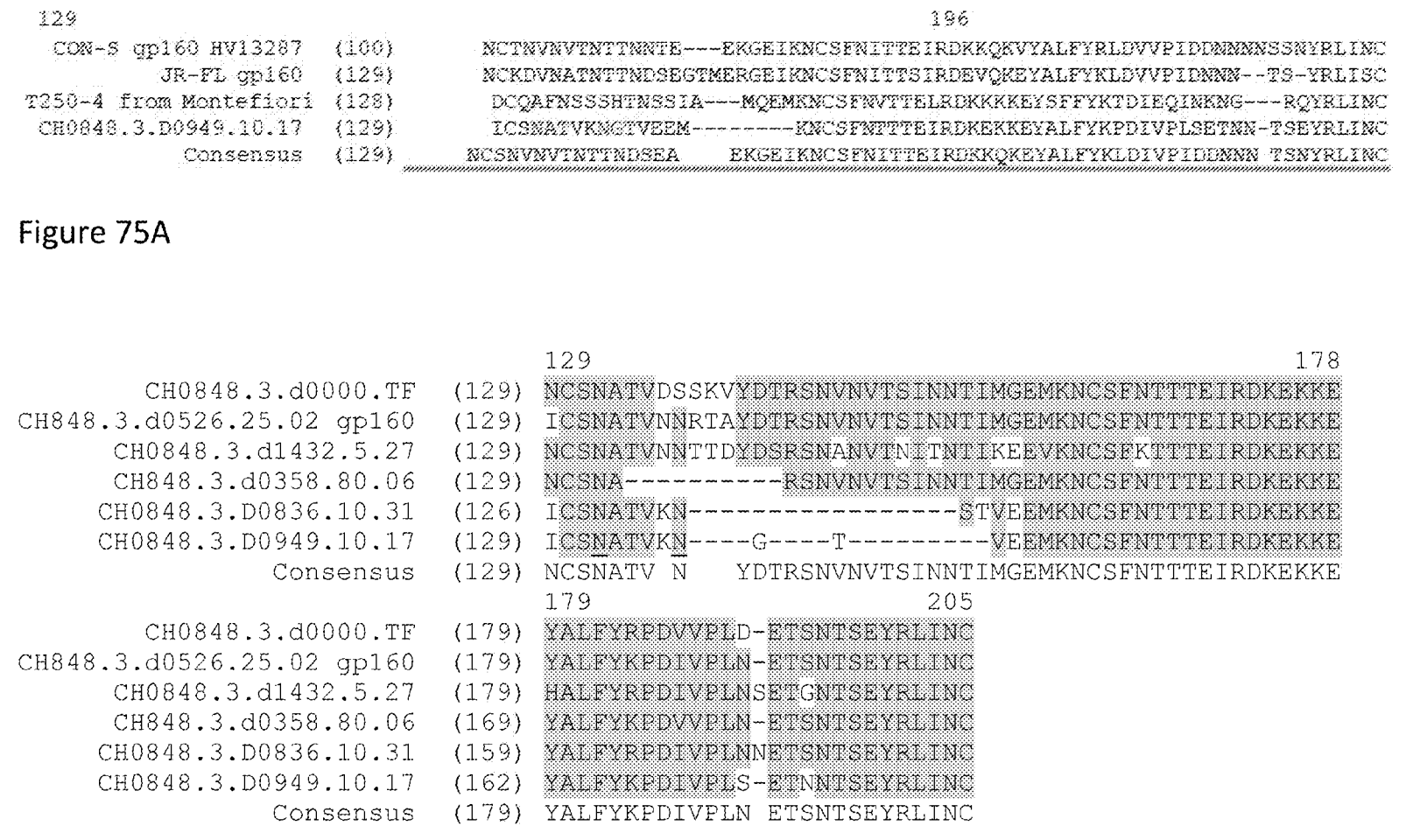

```
                                    129                                                         196
 CON-S gp160 HV13287      (100)    NCTNVNVTNTTNNTE---EKGEIKNCSFNITTEIRDKKQKVYALFYRLDVVPIDDNNNNSSNYRLINC
         JR-FL gp160      (129)    NCKDVNATNTTNDSEGTMERGEIKNCSFNITTSIRDEVQKEYALFYKLDVVPIDNNN--TS-YRLISC
T250-4 from Montefiori    (128)     DCQAFNSSSHTNSSIA---MQEMKNCSFNVTTELRDKKKKEYSFFYKTDIEQINKNG---RQYRLINC
 CH0848.3.D0949.10.17     (129)     ICSNATVKNGTVEEM--------KNCSFNTTTEIRDKEKKEYALFYKPDIVPLSETNN-TSEYRLINC
            Consensus     (129)    NCSNVNVTNTTNDSEA    EKGEIKNCSFNITTEIRDKKQKEYALFYKLDIVPIDDNNN TSNYRLINC
```

Figure 75A

```
                                129                                               178
      CH0848.3.d0000.TF  (129)  NCSNATVDSSKVYDTRSNVNVTSINNTIMGEMKNCSFNTTTEIRDKEKKE
CH848.3.d0526.25.02 gp160  (129)  ICSNATVNNRTAYDTRSNVNVTSINNTIMGEMKNCSFNTTTEIRDKEKKE
     CH0848.3.d1432.5.27  (129)  NCSNATVNNTTDYDSRSNANVTNITNTIKEEVKNCSFKTTTEIRDKEKKE
     CH848.3.d0358.80.06  (129)  NCSNA-----------RSNVNVTSINNTIMGEMKNCSFNTTTEIRDKEKKE
    CH0848.3.D0836.10.31  (126)  ICSNATVKN-----------------STVEEMKNCSFNTTTEIRDKEKKE
    CH0848.3.D0949.10.17  (129)  ICSNATVKN----G----T---------VEEMKNCSFNTTTEIRDKEKKE
               Consensus  (129)  NCSNATV N   YDTRSNVNVTSINNTIMGEMKNCSFNTTTEIRDKEKKE
                                179                      205
      CH0848.3.d0000.TF  (179)  YALFYRPDVVPLD-ETSNTSEYRLINC
CH848.3.d0526.25.02 gp160  (179)  YALFYKPDIVPLN-ETSNTSEYRLINC
     CH0848.3.d1432.5.27  (179)  HALFYRPDIVPLNSETGNTSEYRLINC
     CH848.3.d0358.80.06  (169)  YALFYKPDVVPLN-ETSNTSEYRLINC
    CH0848.3.D0836.10.31  (159)  YALFYRPDIVPLNNETSNTSEYRLINC
    CH0848.3.D0949.10.17  (162)  YALFYKPDIVPLS-ETNNTSEYRLINC
               Consensus  (179)  YALFYKPDIVPLN ETSNTSEYRLINC
```

Figure 75B

>HV1301331_degly3
MPMGSLQPLATLYLLGMLVASVLAAENLWVTVYYGVPVWKEAKTTLFCASDARAYEKKVH
NVWATHACVPTDPSPQELVLGNVTENFNMWKNDMVDQMHEDIISLWDQSLKPCVKLTPLC
VTLICSDATVKTGTVEEMKNCSFNTTTEIRDKEKKEYALFYKPDIVPLSETNNTSEYRLI
NCNTSAVTQACPKVTFEPIPIHYCAPAGYAILKCNDETFNGTGPCSNVSTVQCTHGIRPV
VSTQLLLNGSLAEKEIVIRSENLTNNAKIIIVHLHTPVEIVCTRPNDNTRKSVRIGPGQW
FYATGDIIGDIKQAHCNISEEKWNDTLQKVGIELQKHFPNKTIKYNQSAGGDMEITTHSF
NCGGEFFYCNTSNLFNGTYNGTYISTNSSANSTSTITLQCRIKQIINMWQGVGRAMYAPP
IAGNITCRSNITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALD**

Figure 77A

>HV1301331_N138T
MPMGSLQPLATLYLLGMLVASVLAAENLWVTVYYGVPVWKEAKTTLFCASDARAYEKKVH
NVWATHACVPTDPSPQELVLGNVTENFNMWKNDMVDQMHEDIISLWDQSLKPCVKLTPLC
VTLICSNATVKTGTVEEMKNCSFNTTTEIRDKEKKEYALFYKPDIVPLSETNNTSEYRLI
NCNTSAVTQACPKVTFEPIPIHYCAPAGYAILKCNDETFNGTGPCSNVSTVQCTHGIRPV
VSTQLLLNGSLAEKEIVIRSENLTNNAKIIIVHLHTPVEIVCTRPNNNTRKSVRIGPGQW
FYATGDIIGDIKQAHCNISEEKWNDTLQKVGIELQKHFPNKTIKYNQSAGGDMEITTHSF
NCGGEFFYCNTSNLFNGTYNGTYISTNSSANSTSTITLQCRIKQIINMWQGVGRAMYAPP
IAGNITCRSNITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALD**

Figure 77B

>HV1301345_D368R
MGSLQPLATLYLLGMLVASVLAAENLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSNATVKNGTVEEMKNCSFNTTTEIRDKEKKEYALFYKPDIVPLSETNNTSEYRLINC
NTSACTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGRMEITTHSFNC
GGEFFYCNTSNLFNGTYNGTYISTNSSANSTSTITLQCRIKQIINMWQGVGRCMYAPPIA
GNITCRSNITGLLLTRDGGTNSNETETFRPAGGDMRDNWRSELYKYKVVKIEPLGVAPTR
CKRRVVGRRRRRRAVGIGAVFLGFLGAAGSTMGAASMTLTVQARNLLSGIVQQQSNLLRA
PEAQQHLLKLTVWGIKQLQARVLAVERYLRDQQLLGIWGCSGKLICCTNVPWNSSWSNRN
LSEIWDNMTWLQWDKEISNYTQIIYGLLEESQNQQEKNEQDLLALD**

Figure 77C

>HV1301331_N133DN138T_c-SORTA
MPMGSLQPLATLYLLGMLVASVLAAENLWVTVYYGVPVWKEAKTTLFCASDARAYEKKVH
NVWATHACVPTDPSPQELVLGNVTENFNMWKNDMVDQMHEDIISLWDQSLKPCVKLTPLC
VTLICSDATVKTGTVEEMKNCSFNTTTEIRDKEKKEYALFYKPDIVPLSETNNTSEYRLI
NCNTSAVTQACPKVTFEPIPIHYCAPAGYAILKCNDETFNGTGPCSNVSTVQCTHGIRPV
VSTQLLLNGSLAEKEIVIRSENLTNNAKIIIVHLHTPVEIVCTRPNNNTRKSVRIGPGQW
FYATGDIIGDIKQAHCNISEEKWNDTLQKVGIELQKHFPNKTIKYNQSAGGDMEITTHSF
NCGGEFFYCNTSNLFNGTYNGTYISTNSSANSTSTITLQCRIKQIINMWQGVGRAMYAPP
IAGNITCRSNITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALDLPETGG**

Figure 77D

>HV1301522
MPMGSLQPLATLYLLGMLVASVLAAENLWVTVYYGVPVWKEAKTTLFCASDARAYEKEVH
NVWATHACVPTDPSPQELVLGNVTENFNMWKNDMVDQMHEDIISLWDQSLKPCVKLTPLC
VTLICSDATVKTGTVEEMKNCSFNTTTEIRDKEKKEYALFYKPDIVPLSETNNTSEYRLI
NCNTSACTQACPKVTFEPIPIHYCAPAGYAILKCNDETFNGTGPCSNVSTVQCTHGIRPV
VSTQLLLNGSLAEKEIVIRSENLTNNAKIIIVHLHTPVEIVCTRPNNNTRKSVRIGPGQT
FYATGDIIGDIKQAHCNISEEKWNDTLQKVGIELQKHFPNKTIKYNQSAGGDMEITTHSF
NCGGEFFYCNTSNLFNGTYNGTYISTNSSANSTSTITLQCRIKQIINMWQGVGRCMYAPP
IAGNITCRSNITGLLLTRDGGTNSNETETFRPAGGDMRDNWRSELYKYKVVKIEPLGVAP
TRCKRRVVGRRRRRRAVGIGAVFLGFLGAAGSTMGAASMTLTVQARNLLSGIVQQQSNLL
RAPEAQQHLLKLTVWGIKQLQARVLAVERYLRDQQLLGIWGCSGKLICCTNVPWNSSWSN
RNLSEIWDNMTWLQWDKEISNYTQIIYGLLEESQNQQEKNEQDLLALDGGGSGDIIKLLN
EQVNKEMNSSNLYMSMSSWCYTHSLDGAGLFLFDHAAEEYEHAKKLIIFLNENNVPVQLT
SISAPEHKFEGLTQIFQKAYEHEQHISESINNIVDHAIKSKDHATFNFLQWYVAEQHEEE
VLFKDILDKIELIGNENHGLYLADQYVKGIAKSRKS**

Figure 77E

>HV1301345_N133D_N138T_cSORTA
MGSLQPLATLYLLGMLVASVLAAENLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSDATVKTGTVEEMKNCSFNTTTEIRDKEKKEYALFYKPDIVPLSETNNTSEYRLINC
NTSACTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQGVGRCMYAPPIA
GNITCRSNITGLLLTRDGGTNSNETETFRPAGGDMRDNWRSELYKYKVVKIEPLGVAPTR
CKRRVVGRRRRRRAVGIGAVFLGFLGAAGSTMGAASMTLTVQARNLLSGIVQQQSNLLRA
PEAQQHLLKLTVWGIKQLQARVLAVERYLRDQQLLGIWGCSGKLICCTNVPWNSSWSNRN
LSEIWDNMTWLQWDKEISNYTQIIYGLLEESQNQQEKNEQDLLALDLPETGG**

Figure 77F

>HV1301581
MGSLQPLATLYLLGMLVASVLAKGKLWVTVYYGVPVWKEAKTTLFCASDARAYE
KEVHNVWATHACVPTDPSPQELVLGNVTENFNMWKNDMVDQMHEDIISLWDQSLKPCVKL
TPLCVTLICSDATVKTGTVEEMKNCSFNTTTEIRDKEKKEYALFYKPDIVPLSETNNTSE
YRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLHTPVEIVCTRPNNNTRKSVRIG
PGQTFYATGDIIGDIKQAHCNISEEKWNDTLQKVGIELQKHFPNKTIKYNQSAGGDMEIT
THSFNCGGEFFYCNTSNLFNGTYNGTYISTNSSANSTSTITLQCRIKQIINMWQGVGRAM
YAPPIAGNITCRSNITGLLLTRDGGTNSNETETFRPAGGDMRDNWRSELYKYKVVEIQPL
GIAPTGAKRRVVEREKRAAGLGALFLGFLGAAGSTMGAASITLTVQARQLLSGIVQQQSN
LLRAIEAQQHMLQLTVWGIKQLQARVLALERYLKDQQLLGMWGCSGKLICTTNVPWNTSW
SNKSETDIWDNMTWMQWEREISNYTETIYKLLEDSQNQQERNEQDLLALDSWNSLWNWFS
ITKWLWYIKIFIMIVGGLIGLRIVFAVLSIVNRVRQGYSPLSLQTLTPNPREPDRLRGIE
EEGGEQDRDRSIRLVSGFLPIVWDDLRSLCLFSYHRLRDFLLLAARVVELLGRSSLRGLQ
RGWEVLKYLGSLVQYWGLELKKSAISLFDTLAIAVAEGTDRIIELIQGFCRAIRNIPTRI
RQGFEASLL**

Figure 77G

>HV1301345_TFV1loop
MGSLQPLATLYLLGMLVASVLAAENLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LNCSNATVDSSKVYDTRSNVNVTSINNTIMGEMKNCSFNTTTEIRDKEKKEYALFYRPDV
VPLDETSNTSEYRLINCNTSACTQACPKVTFEPIPIHYCAPAGYAILKCNDETFNGTGPC
SNVSTVQCTHGIRPVVSTQLLLNGSLAEKEIVIRSENLTNNAKIIIVHLHTPVEIVCTRP
NNNTRKSVRIGPGQTFYATGDIIGDIKQAHCNISEEKWNDTLQKVGIELQKHFPNKTIKY
NQSAGGDMEITTHSFNCGGEFFYCNTSNLFNGTYNGTYISTNSSANSTSTITLQCRIKQI
INMWQGVGRCMYAPPIAGNITCRSNITGLLLTRDGGTNSNETETFRPAGGDMRDNWRSEL
YKYKVVKIEPLGVAPTRCKRRVVGRRRRRRAVGIGAVFLGFLGAAGSTMGAASMTLTVQA
RNLLSGIVQQQSNLLRAPEAQQHLLKLTVWGIKQLQARVLAVERYLRDQQLLGIWGCSGK
LICCTNVPWNSSWSNRNLSEIWDNMTWLQWDKEISNYTQIIYGLLEESQNQQEKNEQDLLAL
D**

Figure 77H

>HV1301345_N133D_N138T
MGSLQPLATLYLLGMLVASVLAAENLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSDATVKTGTVEEMKNCSFNTTTEIRDKEKKEYALFYKPDIVPLSETNNTSEYRLINC
NTSACTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQGVGRCMYAPPIA
GNITCRSNITGLLLTRDGGTNSNETETFRPAGGDMRDNWRSELYKYKVVKIEPLGVAPTR
CKRRVVGRRRRRRAVGIGAVFLGFLGAAGSTMGAASMTLTVQARNLLSGIVQQQSNLLRA
PEAQQHLLKLTVWGIKQLQARVLAVERYLRDQQLLGIWGCSGKLICCTNVPWNSSWSNRN
LSEIWDNMTWLQWDKEISNYTQIIYGLLEESQNQQEKNEQDLLALD**

Figure 77I

>CH848.3.D0949.10.17.6R.SOSIP.664
MGSLQPLATLYLLGMLVASVLAKGKLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSNATVKNGTVEEMKNCSFNTTTEIRDKEKKEYALFYKPDIVPLSETNNTSEYRLINC
NTSAVTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQGVGRAMYAPPIA
GNITCRSNITGLLLTRDGGTNSNETETFRPAGGDMRDNWRSELYKYKVVEIQPLGIAPTG
CKRRVVERRRRRRAAGLGALFLGFLGAAGSTMGAASITLTVQARQLLSGIVQQQSNLLRA
PEAQQHMLQLTVWGIKQLQARVLALERYLKDQQLLGMWGCSGKLICCTNVPWNTSWSNKS
ETDIWDNMTWMQWEREISNYTETIYKLLEDSQNQQERNEQDLLALD**

Figure 77J

>CH848.3.D0949.10.17chim.6R.DS.SOSIP.664
MGSLQPLATLYLLGMLVASVLAAENLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSNATVKNGTVEEMKNCSFNTTTEIRDKEKKEYALFYKPDIVPLSETNNTSEYRLINC
NTSACTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQGVGRCMYAPPIA
GNITCRSNITGLLLTRDGGTNSNETETFRPAGGDMRDNWRSELYKYKVVKIEPLGVAPTR
CKRRVVGRRRRRRAVGIGAVFLGFLGAAGSTMGAASMTLTVQARNLLSGIVQQQSNLLRA
PEAQQHLLKLTVWGIKQLQARVLAVERYLRDQQLLGIWGCSGKLICCTNVPWNSSWSNRN
LSEIWDNMTWLQWDKEISNYTQIIYGLLEESQNQQEKNEQDLLALD**

Figure 77K

>CH848.3.D0949.10.17.6R.DS.SOSIP.664
MGSLQPLATLYLLGMLVASVLAKGKLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSNATVKNGTVEEMKNCSFNTTTEIRDKEKKEYALFYKPDIVPLSETNNTSEYRLINC
NTSACTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQGVGRCMYAPPIA
GNITCRSNITGLLLTRDGGTNSNETETFRPAGGDMRDNWRSELYKYKVVEIQPLGIAPTG
CKRRVVERRRRRRAAGLGALFLGFLGAAGSTMGAASITLTVQARQLLSGIVQQQSNLLRA
PEAQQHMLQLTVWGIKQLQARVLALERYLKDQQLLGMWGCSGKLICCTNVPWNTSWSNKS
ETDIWDNMTWMQWEREISNYTETIYKLLEDSQNQQERNEQDLLALD**

Figure 77L

>CH848.3.D0949.10.17.6R.SOSIP.664
MGSLQPLATLYLLGMLVASVLAKGKLWVTVYYGVPVWKEAKTTLFCASDARAYEKEVHNV
WATHACVPTDPSPQELVLGNVTENFNMWKNDMVDQMHEDIISLWDQSLKPCVKLTPLCVT
LICSNATVKNGTVEEMKNCSFNTTTEIRDKEKKEYALFYKPDIVPLSETNNTSEYRLINC
NTSAVTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQTFY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQGVGRAMYAPPIA
GNITCRSNITGLLLTRDGGTNSNETETFRPAGGDMRDNWRSELYKYKVVEIQPLGIAPTG
CKRRVVE*RRRRRR*<u>*AAGLGALFLGFLGAAGSTMGAASITLTVQARQLLSGIVQQQSNLLRA*</u>
<u>*PEAQQHMLQLTVWGIKQLQARVLALERYLKDQQLLGMWGCSGKLICCTNVPWNTSWSNKS*</u>
<u>*ETDIWDNMTWMQWEREISNYTETIYKLLEDSQNQQERNEQDLLALD*</u>**
Signal sequence
*Furin cleavage site*
CH0848.3.D0949.10.17 gp120
**CH0848.3.D0949.10.17 <u>*extracellular gp41 fragment*</u>**

Figure 78A

>CH848.3.D0949.10.17 SOSIPv5.2.8
MGSLQPLATLYLLGMLVASVLAKGKLWVTVYYGVPVWK<u>D</u>A<u>E</u>TTLFCASDARAYEK<u>KKR</u>NV
WATH<u>C</u>CVPTDPSPQELVLGNVTENFNMWKNDMVDQMH<u>T</u>DIISLWDQSLKPCVKLTPLCVT
LICSNATVKNGTVEEMKNCSFNTTTE<u>L</u>RDKEKKEYALFYKPDIVPLSETNNTSEYRLINC
NTSAVTQACPKVTFEPIPIHYCAPAGYAILKCNDETFNGTGPCSNVSTVQCTHGIRPVVS
TQLLLNGSLAEKEIVIRSENLTNNAKIIIVHLHTPVEIVCTRPNNNTRKSVRIGPGQ<u>W</u>FY
ATGDIIGDIKQAHCNISEEKWNDTLQKVGIELQKHFPNKTIKYNQSAGGDMEITTHSFNC
GGEFFYCNTSNLFNGTYNGTYISTNSSANSTSTITLQCRIKQIINMWQ<u>R</u>VG<u>Q</u>AMYAPPIA
GNITCRSNITGLLLTRDGGTNSNETETFRPAGGDMRDNWRSELYKYKVVEIQPLGIAPT<u>R</u>
CKRRVVERRRRRR<u>*AAGLGALFLGFLGAAGSTMGAASMTLTVQARNLLSGIVQQQSNLLRA*</u>
<u>*PECQQHMLQLTVWGIKQLQARVLALERYLKDQQLLGMWGCSGKLICCTNVPWNTSWSNKS*</u>
<u>*ETDIWDNMTWMQWEREISNYTETIYKLLEDSQNQQERNEQDLLALD*</u>**

<u>5.2.8 mutations</u>

Figure 78B

COMPOSITIONS AND METHODS FOR INDUCING HIV-1 ANTIBODIES

This application is a U.S. National Stage application under 35 U.S.C. § 371 of International Patent Application No. PCT/US2018/020788, filed on Mar. 2, 2018, which claims the benefit of and priority to U.S. Provisional Application No. 62/624,620 filed Jan. 31, 2018. International Patent Application No. PCT/US2018/020788 is also a Continuation-In-Part of International Application PCT/US2017/020823 filed Mar. 3, 2017. International Patent Application No. PCT/US2017/020823 claims the benefit of and priority to U.S. Provisional Patent Application No. 62/403,649, filed Oct. 3, 2016, and U.S. Provisional Patent Application No. 62/303,273, filed Mar. 3, 2016. The entire contents of these applications are incorporated herein by reference in their entirety.

This invention was made with government support under Grant No. UM1-AI1006445 awarded by the National Institutes of Health, Division of AIDS, Bethesda, Md. The government has certain rights in this invention.

SEQUENCE LISTING

The instant application contains a Sequence Listing which has been submitted electronically in ASCII format and is hereby incorporated by reference in its entirety and forms part of the specification. Said ASCII copy, created on Jun. 26, 2020, is named 1234300 00321US3 SL.txt and is 1,224,754 bytes in size. The Sequence Listing contains sequences depicted in FIGS. 1-81, inclusive.

TECHNICAL FIELD

The present invention relates, in general, to human immunodeficiency virus (HIV), and, in particular, to HIV-1 immunogenic compositions their methods of making and their use in vaccination regimens.

BACKGROUND

Development of an effective vaccine for prevention of HIV-1 infection is a global priority. To provide protection, an HIV-1 vaccine should induce broadly neutralizing antibodies (bnAbs). One class of bnAbs among antibodies isolated from infected individuals targets the glycan-polypeptide at the base of the envelope third variable loop (V3). However, BnAbs have not been successfully induced by vaccine constructs thus far.

SUMMARY

In certain aspects the invention provides an HIV-1 envelope sequence comprising non-glycosylatable amino acids in the V1 loop, at positions corresponding to N133 and/or N138 in the CH848.3.D0949.10.17 envelope sequence, wherein the envelope protomer sequence is based on the amino acid, comprises amino acids from the CH848.3.D0949.10.17 envelope sequence, and wherein the protomer is deglycosylated in the V1 loop (partially or completely in the V1 loop). In certain embodiments the envelope comprises amino acids substitutions within the CH848.3.D0949.10.17 sequence such that the envelope promoter forms a trimer. Any suitable envelope design or form is contemplated, so long as the envelope is based on CH848.3.D0949.10.17 sequence and the V1 loop is deglycosylated. In some embodiments short V1 loops of various length could be incorporated.

The invention provides amino acid or nucleic acids sequences encoding such deglycosylated proteins. Provided are also nucleic acids, including modified mRNAs which are stable and could be used as immunogens. Provided also are nucleic acids optionally designed as vectors, for example for recombinant expression and/or stable integration, e.g. but not limited, gp160 DNA encoding trimer for stable expression, or VLP incorporation.

In certain embodiments, the deglycosylated envelope is designed as a chimeric trimer chimeric (e.g incorporates amino acids and/or portions of envelope BG505). In certain embodiments, the deglycosylated envelopes are not chimeric, i.e. based on the sequence of envelope CH848.3.D0949.10.17 and comprising amino acids which help trimer formation. In certain embodiments, the envelope is designed as any suitable trimer, such as but not limited to various SOSIP desings, UFO trimers, or any other trimers. In certain embodiments, the envelopes of the invention comprising deglycosylated V1 positions binds and/or neutralizes DH270UCA3 and/or DH270UCA4. The envelope protomer, wherein the envelope is gp120, gp140, gp145, gp150 or gp160. In another aspect the invention provides a method of inducing an immune response in a subject comprising administering a combination of immunogens comprising V3-peptide and/or glycopeptide, wherein the peptide binds to a UCA of a V3 glycan antibody, HIV-1 envelope CH848.0949.10.17; CH848.0836.10.31; CH848.0358.80.06; CH848.1432.5.41; CH848.0526.25.02 in any suitable form or any combination thereof as a prime and/or boost in an amount sufficient to induce an immune response, wherein the envelope is administered as a polypeptide or a nucleic acid encoding the same.

In certain embodiments, the compositions contemplate nucleic acid, as DNA and/or RNA, or proteins immunogens either alone or in any combination. In certain embodiments, the methods contemplate genetic, as DNA and/or RNA, immunization either alone or in combination with envelope protein(s).

In certain embodiments the nucleic acid encoding an envelope is operably linked to a promoter inserted an expression vector. In certain aspects the compositions comprise a suitable carrier. In certain aspects the compositions comprise a suitable adjuvant.

In certain embodiments the induced immune response includes induction of antibodies, including but not limited to autologous and/or cross-reactive (broadly) neutralizing antibodies against HIV-1 envelope. Various assays that analyze whether an immunogenic composition induces an immune response, and the type of antibodies induced are known in the art and are also described herein.

In certain aspects the invention provides an expression vector comprising any of the nucleic acid sequences of the invention, wherein the nucleic acid is operably linked to a promoter. In certain aspects the invention provides an expression vector comprising a nucleic acid sequence encoding any of the polypeptides of the invention, wherein the nucleic acid is operably linked to a promoter. In certain embodiments, the nucleic acids are codon optimized for expression in a mammalian cell, in vivo or in vitro. In certain aspects the invention provides nucleic acids comprising any one of the nucleic acid sequences of invention. In certain aspects the invention provides nucleic acids consisting essentially of any one of the nucleic acid sequences of invention. In certain aspects the invention provides nucleic acids consisting of any one of the nucleic acid sequences of invention. In certain embodiments the nucleic acid of the invention, is operably linked to a promoter and is inserted in an expression vector. In certain aspects the invention provides an immunogenic composition comprising the expression vector.

In certain aspects the invention provides a composition comprising at least one of the nucleic acid sequences of the invention. In certain aspects the invention provides a composition comprising any one of the nucleic acid sequences of invention. In certain aspects the invention provides a composition comprising at least one nucleic acid sequence encoding any one of the polypeptides of the invention.

The envelope used in the compositions and methods of the invention can be in any suitable form: a gp160, gp150, gp145, any suitable form of a trimer, for example but not limited to SOSIP trimers, gp140 (including but not limited to gp140C, gp140CF, gp140CFI), gp120, gp41, N-terminal deletion variants (e.g. delta 11 deletions) as described herein, cleavage resistant variants, or codon optimized sequences thereof.

The polypeptide contemplated by the invention can be a polypeptide comprising any one of the polypeptides described herein. The polypeptide contemplated by the invention can be a polypeptide consisting essentially of any one of the polypeptides described herein. The polypeptide contemplated by the invention can be a polypeptide consisting of any one of the polypeptides described herein. In certain embodiments, the polypeptide is recombinantly produced. In certain embodiments, the polypeptides and nucleic acids of the invention are suitable for use as an immunogen, for example to be administered in a human subject.

In certain embodiments the envelope is any of the forms of HIV-1 envelope. In certain embodiments the envelope is gp120, gp140, gp145 (i.e. with a transmembrane), gp150, optionally as a trimer. In certain embodiments the trimer is a chimeric SOSIP trimer. See WO2016/037154 incorporated by reference in its entirety. In certain embodiments, envelope trimers are purified from cellular recombinant fractions by antibody binding and reconstituted in lipid comprising formulations. See for example WO2015/127108 titled "Trimeric HIV-1 envelopes and uses thereof" which content is herein incorporated by reference in its entirety. In certain embodiments, the envelope is in a liposome and transmembrane with a cytoplasmic tail in a liposome. In certain embodiments, the nucleic acid comprises a nucleic acid sequence which encode a gp120, gp140 (including but not limited to gp140C, gp140CF, gp140CFI), gp145, gp150 or gp160.

The envelope used in the compositions and methods of the invention can be a gp160, gp150, gp145, gp140, gp120, gp41, N-terminal deletion variants as described herein, cleavage resistant variants as described herein, or codon optimized sequences thereof. In certain embodiments the composition comprises envelopes as trimers. In certain embodiments, envelope proteins are multimerized, for example trimers are attached to a particle such that multiple copies of the trimer are attached and the multimerized envelope is prepared and formulated for immunization in a human. In certain embodiments, the compositions comprise envelopes, including but not limited to trimers as particulate, high-density array on liposomes or other particles, for example but not limited to nanoparticles. In some embodiments, the trimers are in a well ordered, near native like or closed conformation. In some embodiments the trimer compositions comprise a homogenous mix of native like trimers. In some embodiments the trimer compositions comprise at least 85%, 90%, 95% native like trimers.

In certain embodiments, where the nucleic acids are operably linked to a promoter and inserted in a vector, the vectors is any suitable vector. Non-limiting examples, include, the VSV, replicating rAdenovirus type 4, MVA, Chimp adenovirus vectors, pox vectors, and the like. In certain embodiments, the nucleic acids are administered in NanoTaxi block polymer nanospheres. In certain embodiments, the composition and methods comprise an adjuvant. Non-limiting examples include, AS01 B, AS01 E, Gla/SE, alum, Poly I poly C (in any form, including but not limited to PolyIC/long chain (LC)), TLR agonists, TLR7/8 and 9 agonists, or a combination of TLR7/8 and TLR9 agonists (see Moody et al. (2014) J. Virol. March 2014 vol. 88 no. 6 3329-3339), or any other adjuvant. Non-limiting examples of TLR7/8 agonist include TLR7/8 ligands, Gardiquimod, Imiquimod and R848 (resiquimod). A non-limiting embodiment of a combination of TLR7/8 and TLR9 agonist comprises R848 and oCpG in STS (see Moody et al. (2014) J. Virol. March 2014 vol. 88 no. 6 3329-3339).

In certain aspects, the invention provides a kit comprising a combination/selection of immunogens, for example but not limited to immunogens in FIG. 37A-D, and Example 3. In some embodiments the selection of immunogens is selection F, selection G, or selection H. In some embodiments the kit comprises instructions on how to carry out the immunization regimen. In some embodiments the kit comprises instructions on administration of the selection of immunogens as a prime or boost as part of a prime/boost immunization regimen.

In certain aspects the invention provides a recombinant HIV-1 envelope polypeptide, wherein the polypeptide comprises the amino acid sequence of any one of the envelopes designs in Table 1, Table 3, Example 3, Example 5. In certain embodiments the envelope is engineered with modifications so as to improve its binding to the DH270UCA antibody. In certain embodiments, the engineered envelope is based on the sequence of HIV-1 envelope CH848.0949.10.17. In certain embodiments, the protein does not include the signal peptide. In certain aspects the invention provides a recombinant HIV-1 envelope polypeptide from Table 1, Table 3, Example 3, Example 5 wherein the polypeptide is non-naturally occurring and designed to form a soluble trimer. In certain embodiments, the protein does not include the signal peptide. In certain aspects the invention provides a nucleic acid encoding any one of the polypeptides of the invention. In certain embodiments, the nucleic acids could be formulated in any suitable way for immunogenic delivery of nucleic acids.

In certain aspects the invention provides an immunogenic composition comprising the recombinant HIV-1 envelope polypeptides of the invention and a carrier. In certain aspects the invention provides an immunogenic composition comprising the nucleic acid of the invention and a carrier. The compositions could comprise an adjuvant.

A method of inducing an immune response in a subject comprising administering a composition comprising an HIV-1 envelope polypeptide(s) in an amount sufficient to induce an immune response from one or more of the following groups:

deglycosylated envelope polypeptide form(s) of CH848.0949.10.17 designed to bind DH270UCA (Table 1, Table 3, Table 4, Ex. 3, Ex. 5), or any combination thereof as a prime;

and wherein the administration step can alternatively, or in addition, comprise administering any suitable form of a nucleic acid(s) encoding an HIV-1 envelope polypeptide(s) in an amount sufficient to induce an immune response from one or more of the following groups:

deglycosylated envelope polypeptide form(s) of CH848.0949.10.17 designed to bind DH270UCA (Table 1, Table 3, Table 4, Ex. 3, Ex. 5), or any combination thereof as a prime.

In certain aspects the invention provides methods of inducing an immune response in a subject comprising administering a composition comprising an HIV-1 envelope polypeptide(s) in an amount sufficient to induce an immune response from one or more of the following groups:

(a) deglycosylated envelope polypeptide form(s) of CH848.0949.10.17 designed to bind DH270UCA (Table 1, Table 3, Table 4, Ex. 3, Ex. 5), or any combination thereof as a prime;

(b) envelope polypeptide(s) CH848.0949.10.17, CH848.0836.10.31, CH848.0358.80.06; CH848.1432.5.41; CH848.0526.25.02 (FIG. 37A), or any combination thereof;

(c) envelope polypeptide CH0848.3.d1651.10.07;

and wherein the administration step can alternatively, or in addition, comprise administering any suitable form of a nucleic acid(s) encoding an HIV-1 envelope polypeptide(s) in an amount sufficient to induce an immune response from one or more of the following groups:

(a) deglycosylated envelope polypeptide form(s) of CH848.0949.10.17 designed to bind DH270UCA (Table 1, Table 3, Table 4, Ex. 3, Ex. 5), or any combination thereof as a prime;

(b) envelope polypeptide(s) CH848.0949.10.17, CH848.0836.10.31, CH848.0358.80.06; CH848.1432.5.41; CH848.0526.25.02 (FIG. 37A), or any combination thereof;

(c) envelope polypeptide CH0848.3.d1651.10.07.

In certain embodiments, the first boost administered after the prime comprises HIV-1 envelope polypeptide CH848.0949.10.17 in any suitable form. In certain embodiments the boos could comprise any of the envelopes of the invention. In certain embodiments the boost is any of the envelopes of Table 1, Table 3 or Table 4. Non-limiting embodiment include any of the envelopes in FIG. 50.

In certain embodiments, the nucleic acid encodes a gp120 envelope, gp120D11 envelope, a gp140 envelope (gp140C, gp140CF, gp140CFI) as soluble or stabilized protomer of a SOSIP trimer, a gp145 envelope, a gp150 envelope, or a transmembrane bound envelope. In certain embodiments, the polypeptide is gp120 envelope, gp120D11 envelope, a gp140 envelope (gp140C, gp140CF, gp140CFI) as soluble or stabilized protomer of a SOSIP trimer, a gp145 envelope, a gp150 envelope, or a transmembrane bound envelope. In certain embodiments, the methods further comprise administering an agent which modulates host immune tolerance. In certain embodiments, the immunogen of the invention is multimerized in a liposome or nanoparticle. In certain embodiment, the methods further comprise administering one or more additional HIV-1 immunogens to induce a T cell response.

In certain aspects the invention provides a kit comprising a combination/selection of immunogens of Selection I (V3 peptide in any suitable form such aglycone, glycosylated, multimerized, carrying T cell epitopes, etc.); recombinant HIV-1 envelopes CH848.0949.10.17; CH848.0358.80.06; CH848.1432.5.41; CH848.0526.25.02), and optionally envelope polypeptide CH0848.3.d1651.10.0, and/or a nucleic acid encoding the same in any suitable form. A kit comprising a combination/selection of immunogens comprising any suitable envelope design which binds to the DH270UCA; recombinant HIV-1 envelopes CH848.0949.10.17; CH848.0358.80.06; CH848.1432.5.41; CH848.0526.25.02), and optionally envelope polypeptide CH0848.3.d1651.10.0, and/or a nucleic acid encoding the same in any suitable form. The envelope and/or nucleic acid in the kits of the invention could be in any suitable form. The V3 peptide in the kits of the invention could be of SEQ ID NO: 1. In some embodiments the peptide is glycosylated. In some embodiments, the peptide is not glycosylated. In some embodiments the kit comprises an adjuvant. In some embodiment the kit comprises instructions on how to carry out the immunization regiment: the immunogen could be administered sequentially or additively.

In certain aspects the invention provides a recombinant CH848 envelope protein designed to form a soluble trimer, wherein the CH848 envelope protein comprises the sequence of any one of the envelopes or designs in Tables 1, 3, 4 and Ex, 3. Ex. 5, FIG. 39A, 40A or 41A, FIG. 49, et seq. In certain embodiments, the protein does not include the signal peptide.

In certain aspects the invention provides an immunogenic composition comprising the recombinant HIV-1 envelope CH848.0949.10.17, CH848.0836.10.31, CH848.0358.80.06; CH848.1432.5.41; CH848.0526.25.02 in any suitable form or a nucleic acid encoding the same. In certain embodiments the recombinant envelope comprises the sequence of the CHIM.6R.SOSIP.664V4.1 design, or any other suitable trimer design, or multimerized timer. In certain embodiments the recombinant envelope comprises the sequence any other envelope form (See e.g. FIGS. 39-41, 49-78; other forms such as gp140C, gp140CF, gp140CFI). The invention also provides compositions comprising suitable form of an HIV-1 envelope polypeptide or any suitable form of a nucleic acid encoding HIV-1 envelope from the selections of envelopes listed in Tables 1, 3 and Ex, 3, Ex. 5 FIG. 39A, 40A or 41A, 49, or any combination thereof.

In certain aspects the invention provides a kit comprising a combination/selection of immunogens described in Tables 1, 3 and Ex, 3, and instructions for which immunogen are administered as a prime and which immunogens are administered as a boost. In some embodiments the kit of Selection I (V3 peptide in any suitable form such aglycone, glycosylated, multimerized, carrying T cell epitopes, etc.; recombinant HIV-1 envelopes CH848.0949.10.17; CH848.0358.80.06; CH848.1432.5.41; CH848.0526.25.02) and/or a nucleic acid encoding the same. The envelope and/or nucleic acid in the kits of the invention could be in any suitable form. The V3 peptide in the kits of the invention could be of SEQ ID NO: 1. In some embodiments the peptide is glycosylated. In some embodiments, the peptide is not glycosylated. In some embodiments the kit comprises an adjuvant. In some embodiment the kit comprises instructions on how to carry out the immunization regiment: the immunogen could be administered sequentially or additively.

In some aspects the invention provides a recombinant cell, a clonal population of cells, or a pool of cells comprising a nucleic acid encoding any one of the envelope proteins or immunogens of the invention.

A recombinant HIV-1 Envelope ectodomain trimer, comprising three gp120-gp41 protomers comprising a gp120 polypeptide and a gp41 ectodomain, wherein each protomer is the same and comprises portions from envelope BG505 HIV-1 strain and gp120 polypeptide portions from a CH0848 HIV-1 strain and stabilizing mutations A316W and E64K, wherein the trimer is stabilized in a prefusion mature closed conformation, and wherein the trimer does not comprise non-natural disulfide bond between cysteine substitutions at positions 201 and 433 of the HXB2 reference sequence. In some embodiments, the amino acid sequence of one monomer of trimer. In some embodiments, the trimer is immunogenic. In some embodiments the trimer binds to any one of the antibodies PGT145, PGT151, CH103UCA, CH103, VRC01, PGT128, or any combination thereof. In some embodiments the trimer does not bind to antibody 19B and/or 17B.

In certain embodiments the compositions comprising trimers are immunogenic. In certain aspects, the invention provides a pharmaceutical composition comprising any one of the recombinant trimers of the invention. In certain embodiments the compositions comprising trimers are immunogenic. The percent trimer in such immunogenic compositions could vary. In some embodiments the composition comprises 70%, 71%, 72%, 73%, 74%, 75%, 76%, 77%, 78%, 79%, 80%, 81%, 82%, 83%, 84%, 85%, 86%, 87%, 89%, 90%, 91%, 92%, 93%, 94%, 95%, 96%, 97%, 98%, 99% stabilized trimer.

In certain aspects the invention is directed to recombinant HIV-1 envelope which comprises changes in the amino acid sequence such that the envelope is partially deglycosylated. In certain embodiments, the partially deglycosylated envelopes binds to specific UCA antibodies, including but not limited to the DH270 UCA. The contemplated changes are with respect to a reference envelope sequence, which may or may not be naturally occurring. In certain embodiments deglycosylation is in the V1 loop of the HIV-1 envelope. In certain embodiments these changes are at positions N133, N138, N156, N301, N332, or any combination thereof. In certain non-limiting embodiments where the envelope is deglycosylated at positions N133 and/or N138, the envelope is glycosylated at positions N301 and N332 (See Example 5, FIGS. 49-78). Position given with respect to V1 loop sequence shown in FIG. 75.

Any suitable amino acid change is contemplated so long as glycosylation at that position is abolished. Non-limiting embodiments include amino acids which are naturally occurring at the respective position in other envelopes such that the modified envelopes are deglycosylated. Non-limiting amino acid changes include change to alanine, or any of the following: N133D, N138T, N301A, N301S, N332A, N332T. Any envelope form, e.g. but not limited to stabilized SOSIP trimer designs, gp140s, etc. could be designed to comprise deglycosylation mutations. In some embodiments, the envelope is CH848.3.D0949.10.17CHIM.6R.SOSIP.664V4.1 N133DN138T. In other embodiments, the envelope is CH848.3.D0949.10.17CHIM.6R.SOSIP.664V4.1_N133DN 138T and further comprises N301mut.

In certain aspects, he invention provides compositions comprising these deglycosylated envelopes. In certain embodiments, these deglycosylated envelopes are used as immunogens. In certain embodiments, these deglycosylated envelopes are comprised in immunogenic compositions with suitable carriers and/or adjuvants.

The invention also contemplates multimerized forms of any of the recombinant envelopes of the invention. In certain aspects the invention provides immunogenic compositions and their use to induce immune responses, wherein the envelope immunogen structure is stabilized by the addition of small molecules. A non-limiting example of such compound is BMS-626529.

In certain aspects, the invention provides methods of inducing immune response in a subject comprising administering compositions comprising deglycosylated envelopes. In some embodiments these deglycosylated envelopes are administered as a prime. In some embodiments, the prime could be a nucleic acid encoding a deglycosylaed The glycosylated envelopes could also be administered as a boost.

The invention provides compositions comprising V3 antibody immunogens and methods for inducing antibodies to the V3 HIV-1 envelope region. In one aspect the invention provides selection of immunogens which are used to induce V3 antibodies. In some embodiments, the immunogens include a homogeneous minimal immunogen with high mannose glycans reflective of a native Env V3-glycan bnAb epitope, ($Man_9$-V3). In some embodiments, the immunogens include a homogeneous minimal immunogen without glycans.

V3-glycan bnAbs bound to $Man_9$-V3 glycopeptide and native-like gp140 trimers with similar affinities. Both fluorophore-labeled $Man_9$-V3 or native-like trimers similarly bound to bnAb memory B cells, and by flow sorting isolated members of a bnAb clonal lineage from an HIV-1-infected individual. The glycopeptide of FIG. 38A-E bound the germline of a V3-glycan bnAb lineage. Thus, a $Man_9$-V3 glycopeptide mimics a HIV-1 V3-glycan bnAb epitope and is a candidate immunogen to initiate V3-glycan bnAb lineage maturation.

In some embodiments the compositions comprise immunologically and pharmaceutically acceptable carriers and/or excipients.

BRIEF DESCRIPTION OF THE DRAWINGS

To conform to the requirements for PCT patent applications, many of the figures presented herein are black and white representations of images originally created in color.

FIGS. 2A-D. Heterologous breadth in the DH270 lineage. (A) Neutralizing activity of DH270.1, DH270.5 and DH270.6 bnAbs (columns) for 207 tier 2 heterologous viruses (rows). Coloring is by neutralization $IC_{50}$ (g/ml). The first column displays presence of a PNG site at position 332 (blue), N334 (orange) or at neither one (black). The second column indicates the clade of each individual HIV-1 strain and is color coded as indicated: clade A: green; clade B: blue; clade C: yellow; clade D: purple; CRF01: pink; clade G: cyan; others: gray. See FIG. 33. (B). Heterologous neutralization of all DH270 lineage antibodies for a 24-virus panel. Color coding for presence of PNG sites, clade and $IC_{50}$ is the same of panel A. See FIGS. 7A-D and FIGS. 34-35. (C) Co-variation between $V_H$ mutation frequencies (x-axis), neutralization breadth (y-axis, top panels) and potency (y-axis, bottom panels) of individual antibodies against viruses with a PNG site at position N332 from the larger (left) and smaller (right) pseudovirus panels. (D)

Correlation between viral V1 loop length and DH270 lineage antibody neutralization. Top panel: neutralization of 17 viruses (with N332 and sensitive to at least one DH270 lineage antibody) by selected DH270 lineage antibodies from UCA to mature bnAbs (x-axis). Viruses are identified by their respective V1 loop lengths (y-axis); for each virus, neutralization sensitivity is indicated by an open circle and resistance by a solid circle. The p-value is a Wilcoxon rank sum comparison of V1 length distributions between sensitive and resistant viruses. Bottom panel: regression lines ($IC_{50}$ for neutralization vs. V1 loop length) for DH270.1 and DH270.6, with a p-value based on Kendall's tau.

FIGS. 3A-E. A single disfavored mutation early during DH270 clonal development conferred neutralizing activity to the V3 glycan bnAb DH270 precursor antibodies. (A) Nucleotide (nt) alignment of DH270.IA4 and DH272 to $V_H$1-2*02 sequence at the four $V_H$ positions that mutated from DH270.UCA to DH270.IA4. The mutated codons are highlighted in yellow. AID hotspots are indicated by red lines (solid: canonical; dashed: non-canonical); AID cold spots by blue lines (solid: canonical; dashed: non-canonical) (20). At position 169, DH270.IA4 retained positional conformity with DH272 but not identity conformity (red boxes). (B) Sequence logo plot of aa mutated from germline (top) in NGS reads of the DH270 (middle) and DH272 (bottom) lineages at weeks 186 and 111 post-transmission, respectively. Red asterisks indicate aa mutated in DH270.IA4. The black arrow indicates lack of identity conformity between the two lineages at aa position 57. (C) Sequence logo plot of nucleotide mutations (position 165-173) in the DH270 and DH272 lineages at weeks 186 and 111 post-transmission, respectively. The arrow indicates position 169. (D) Effect of reversion mutations on DH270.IA4 neutralization. Coloring is by $IC_{50}$. (E) Effect of G57R mutation on DH270.UCA autologous (top) and heterologous (bottom) neutralizing activity.

Figure 4A:
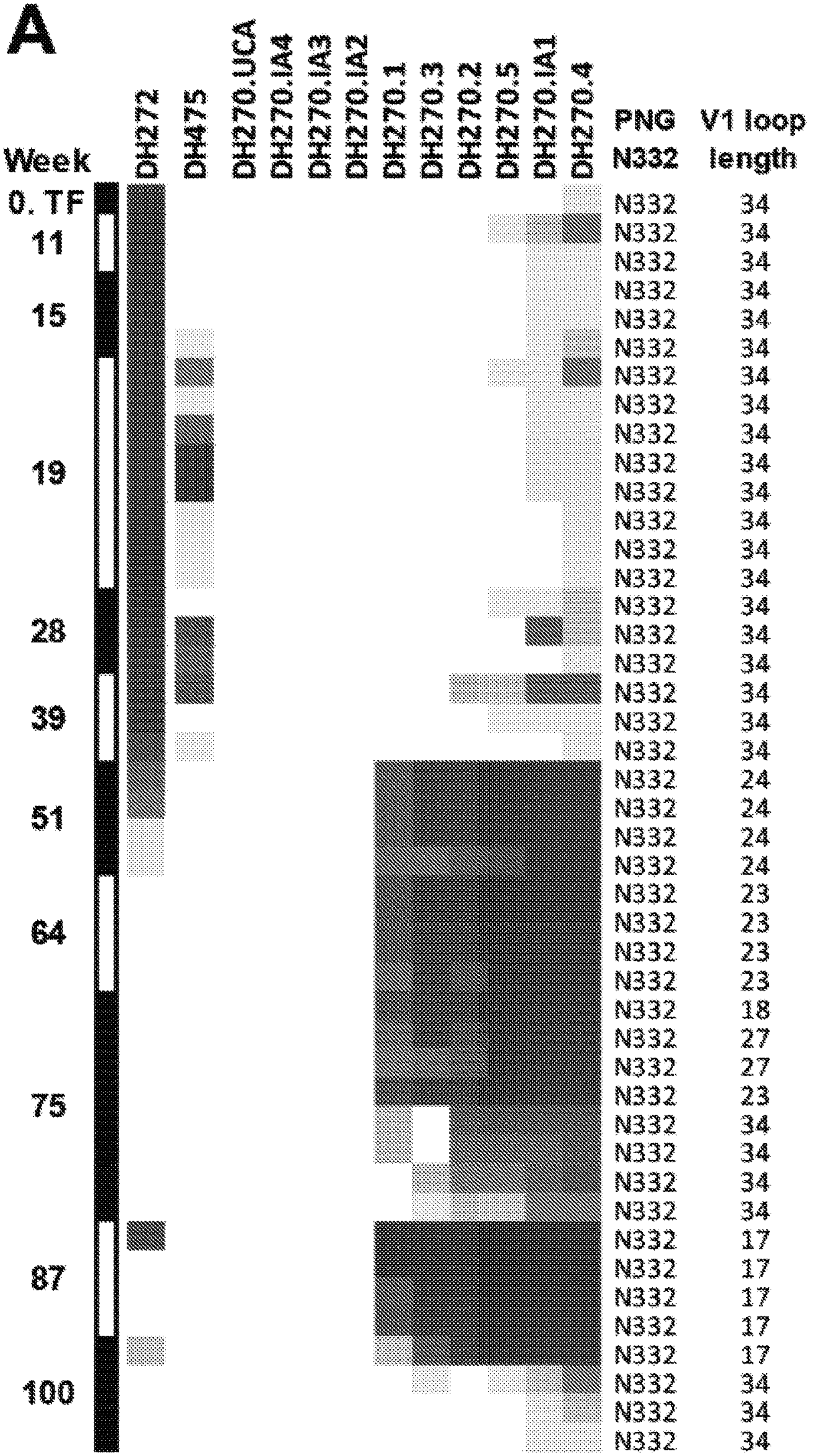
Figure 4A:
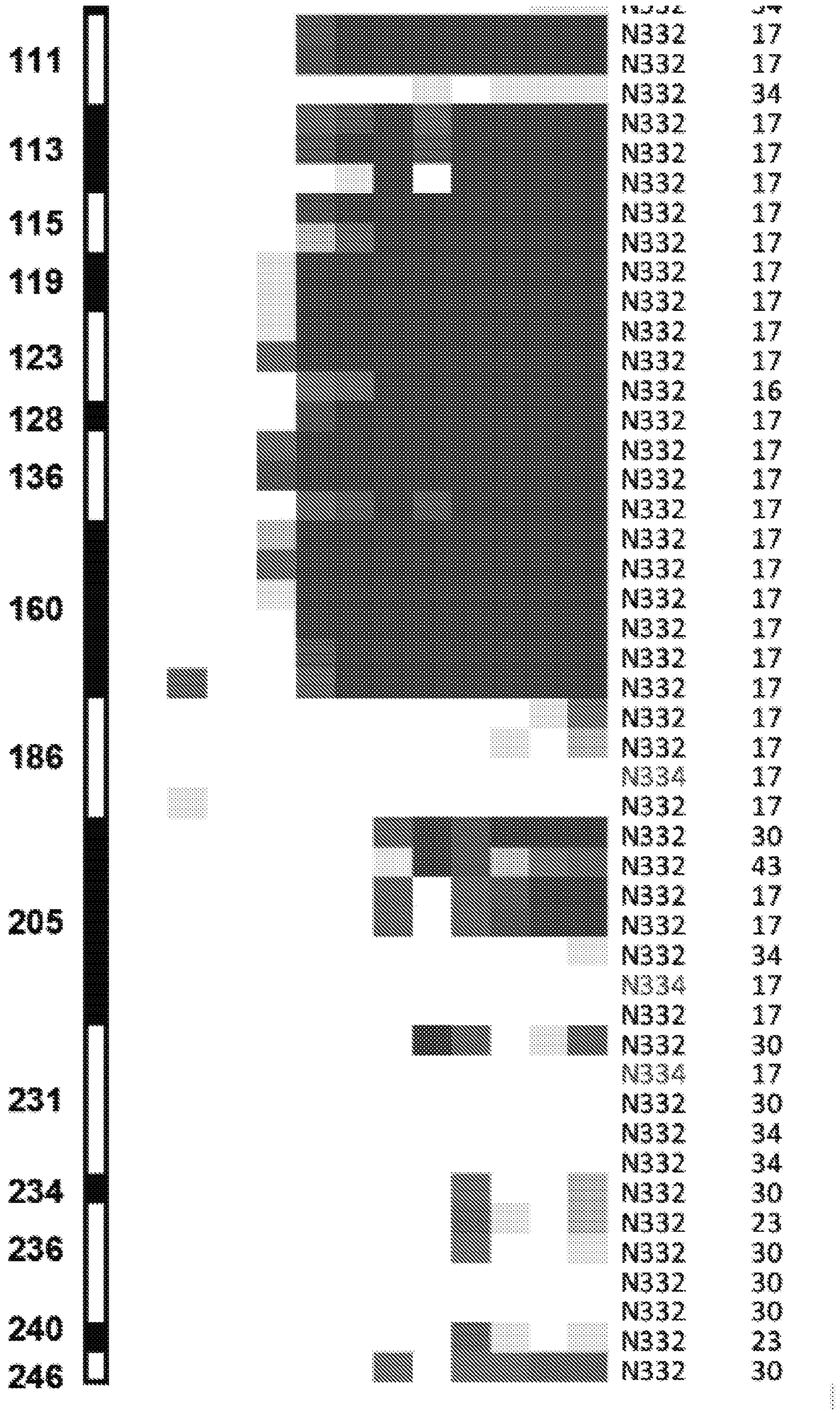
Figures 4B, 4C:
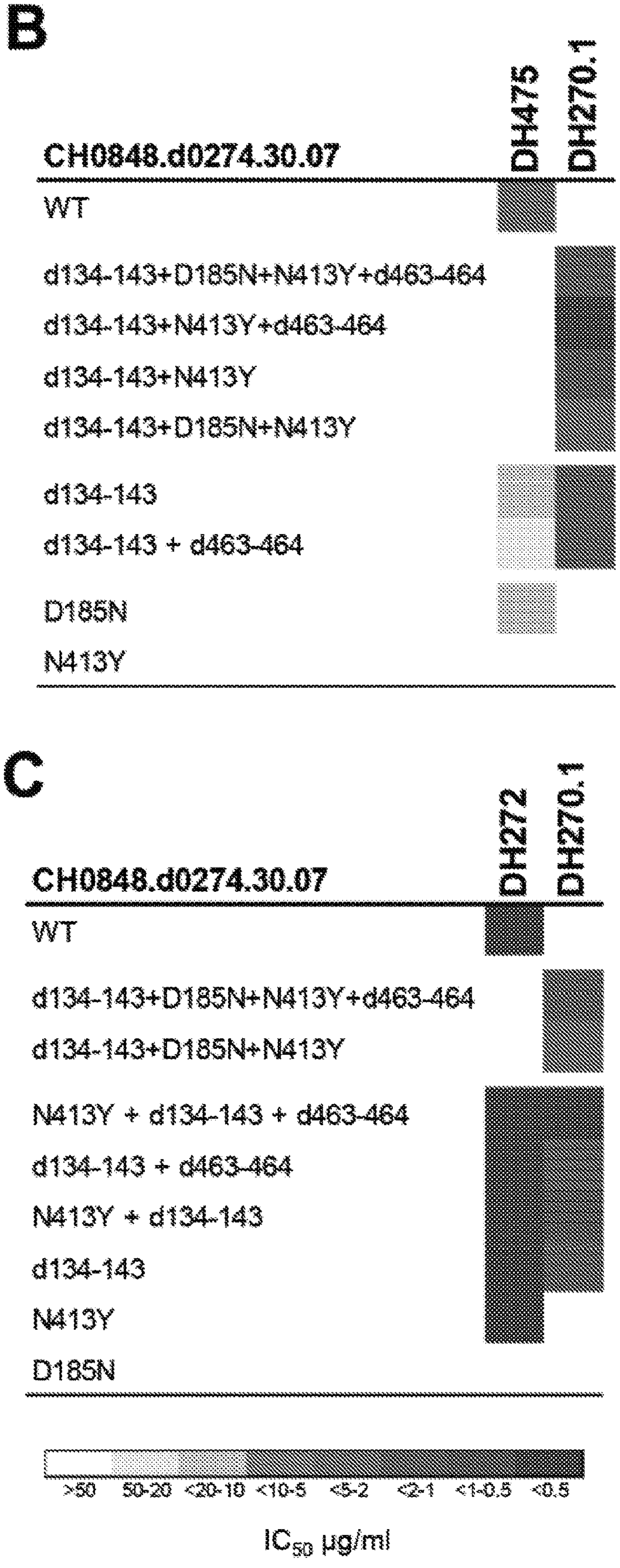

FIGS. 4A-C. Cooperation among DH270, DH272 and DH475 N332 dependent V3 glycan nAb lineages. (A) Neutralizing activity of DH272, DH475 and DH270 lineage antibodies (columns) against 90 autologous viruses isolated from CH848 over time (rows). Neutralization potency ($IC_{50}$) is shown as indicated in the bar. For each pseudovirus, presence of an N332 PNG site and V1 loop length are indicated on the right. Also see FIGS. 34-35. (B, C) Susceptibility to DH270.1 and to (B) DH475 or (C) DH272 of autologous viruses bearing selected immunotype-specific mutations.

FIGS. 5A-H. Fab/scFv crystal structures and 3D-reconstruction of DH270.1 bound with the 92BR SOSIP.664 trimer. Superposition of backbone ribbon diagrams for DH270 lineage members: UCA1 (gray), DH270.1 (green), and DH270.6 (blue) (A) alone, (B) with the DH272 cooperating antibody (red), (C) with PGT 128 (magenta), and (D) with PGT124 (orange). Arrows indicate major differences in CDR regions. (E) Top and (F) side views of a fit of the DH270.1 Fab (green) and the BG505 SOSIP trimer (gray) into a map obtained from negative-stain EM. (G) Top and (H) side views of the BG505 trimer (PDB ID: 5ACO) (28) (gray, with V1/V2 and V3 loops highlighted in red and blue, respectively) bound with PGT124 (PDB ID: 4R2G) (27) (orange), PGT128 (PDB ID: 3TYG) (17) (magenta), PGT135 (PDB ID: 4JM2) (22) (cyan) and DH270.1 (green), superposed. The arrows indicate the direction of the principal axis of each of the bnAb Fabs; the color of each arrow matches that of the corresponding bnAb. See also FIG. 24.

Figure 6A:
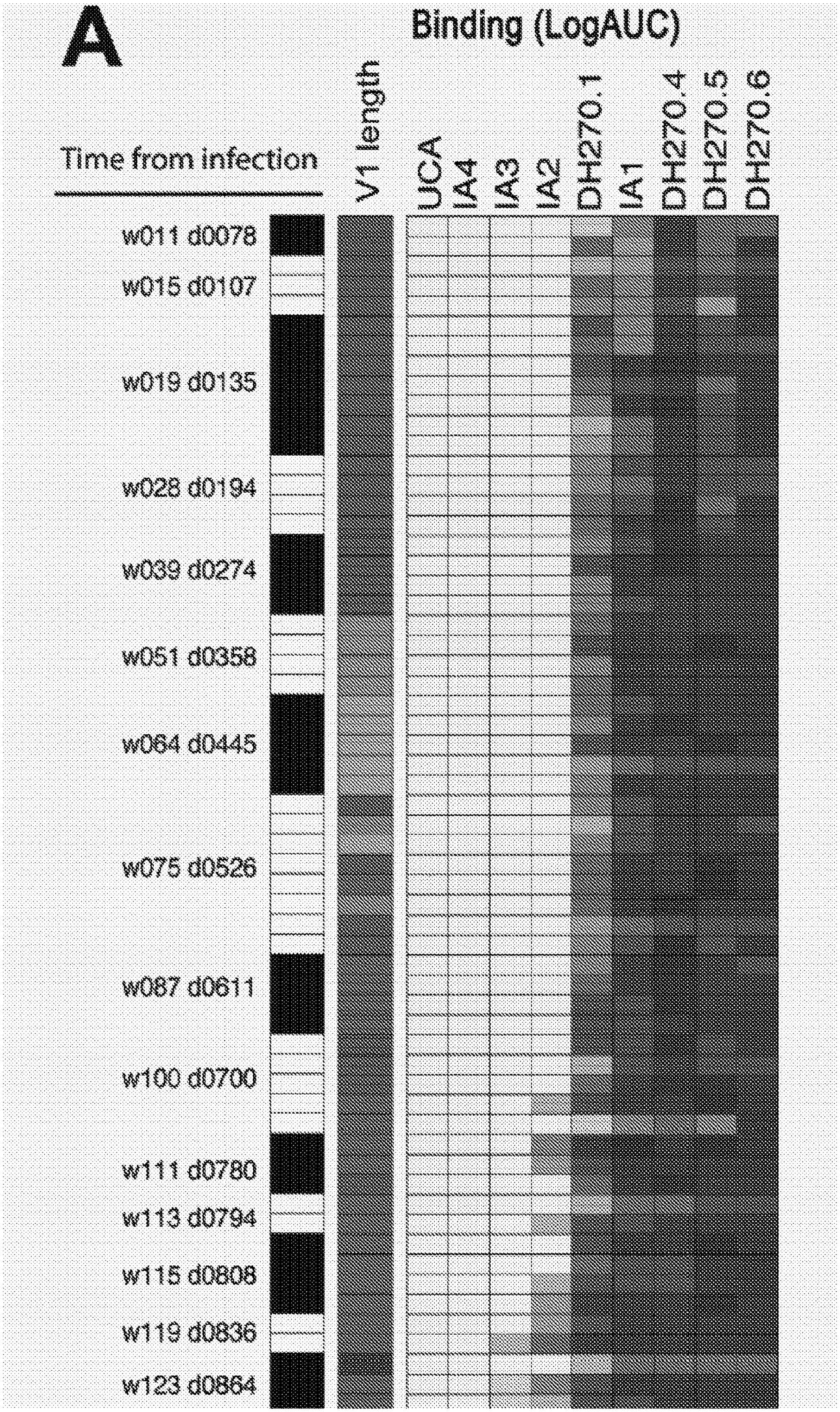
Figure 6A:
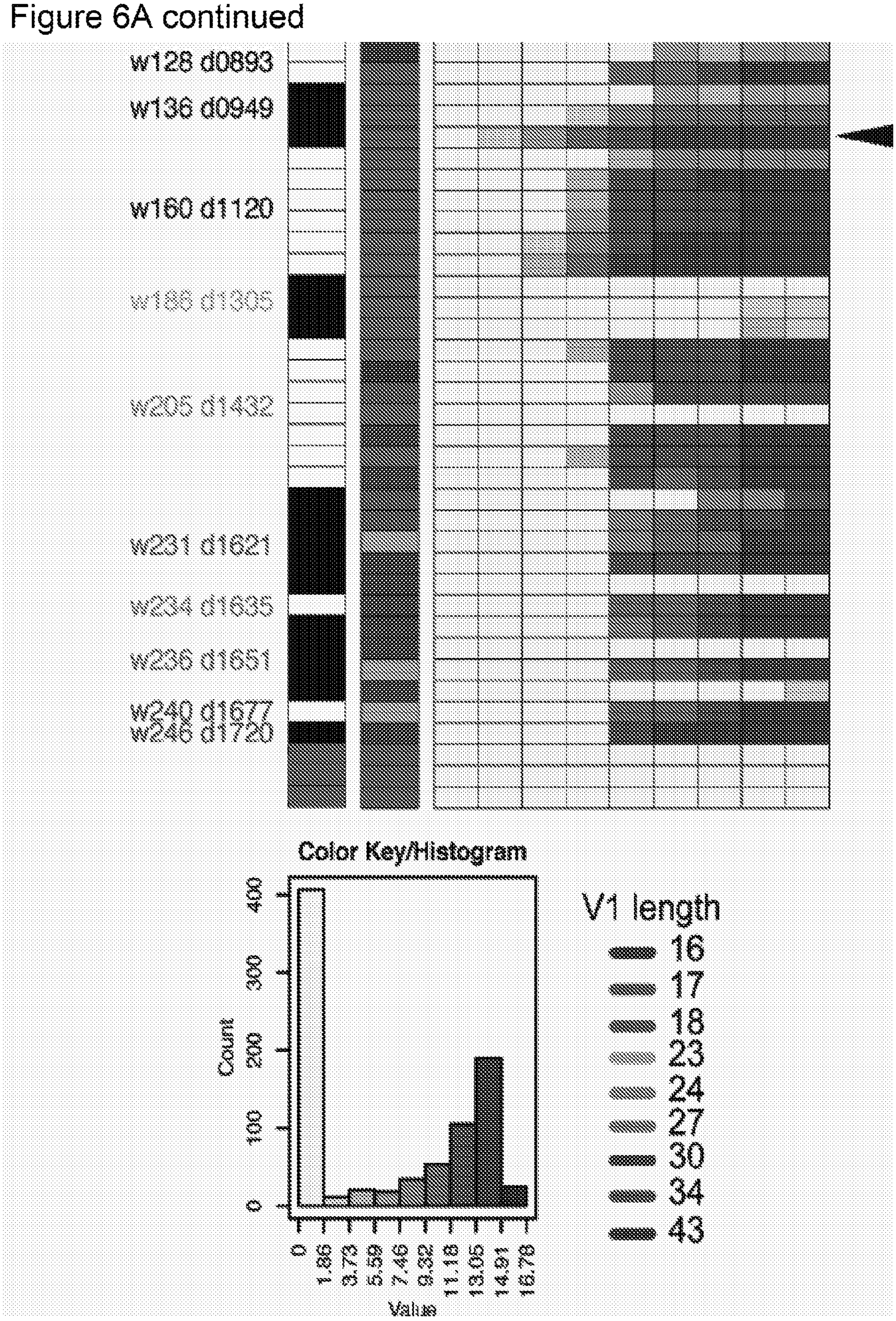
Figure 6B:
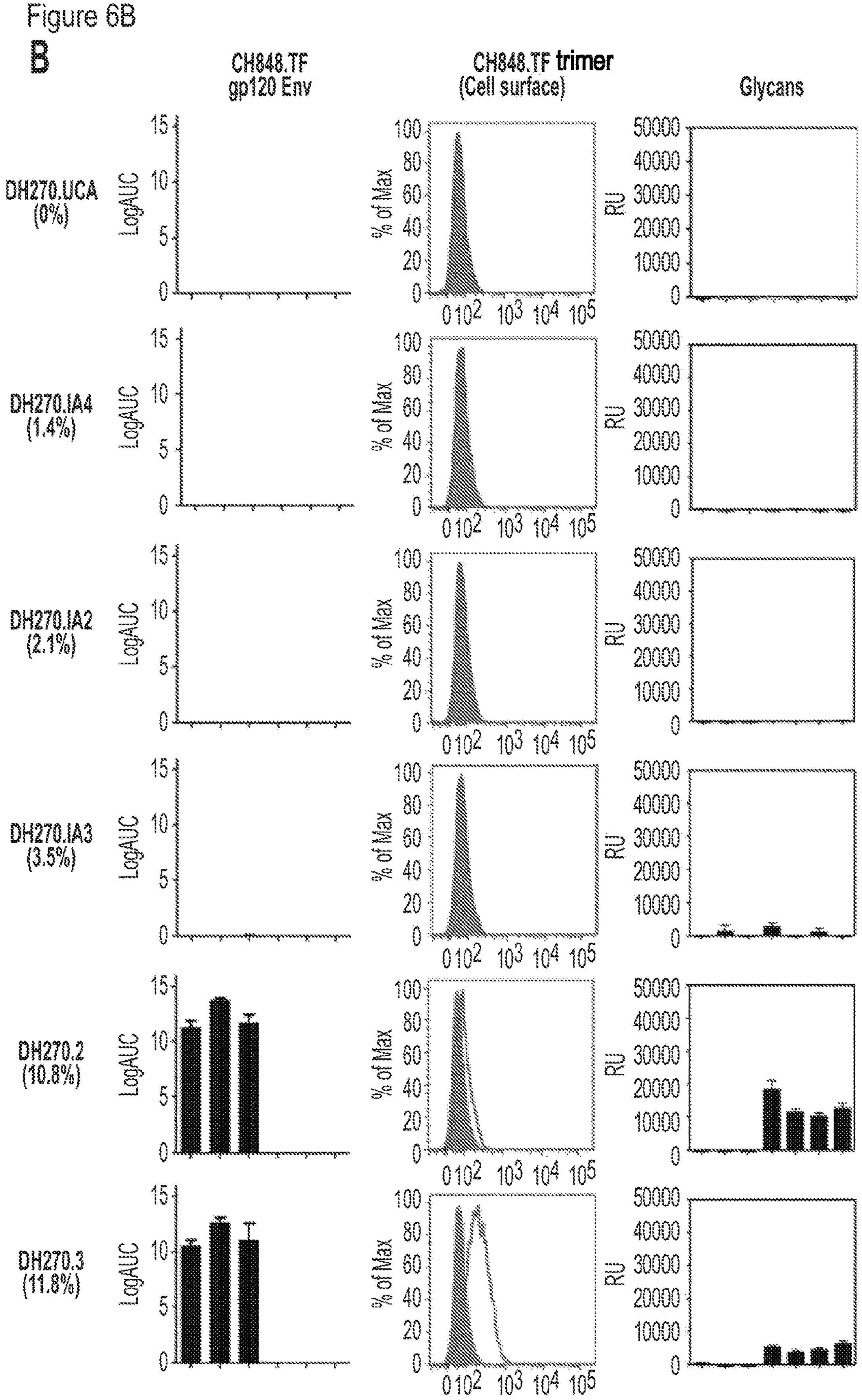
Figure 6B:
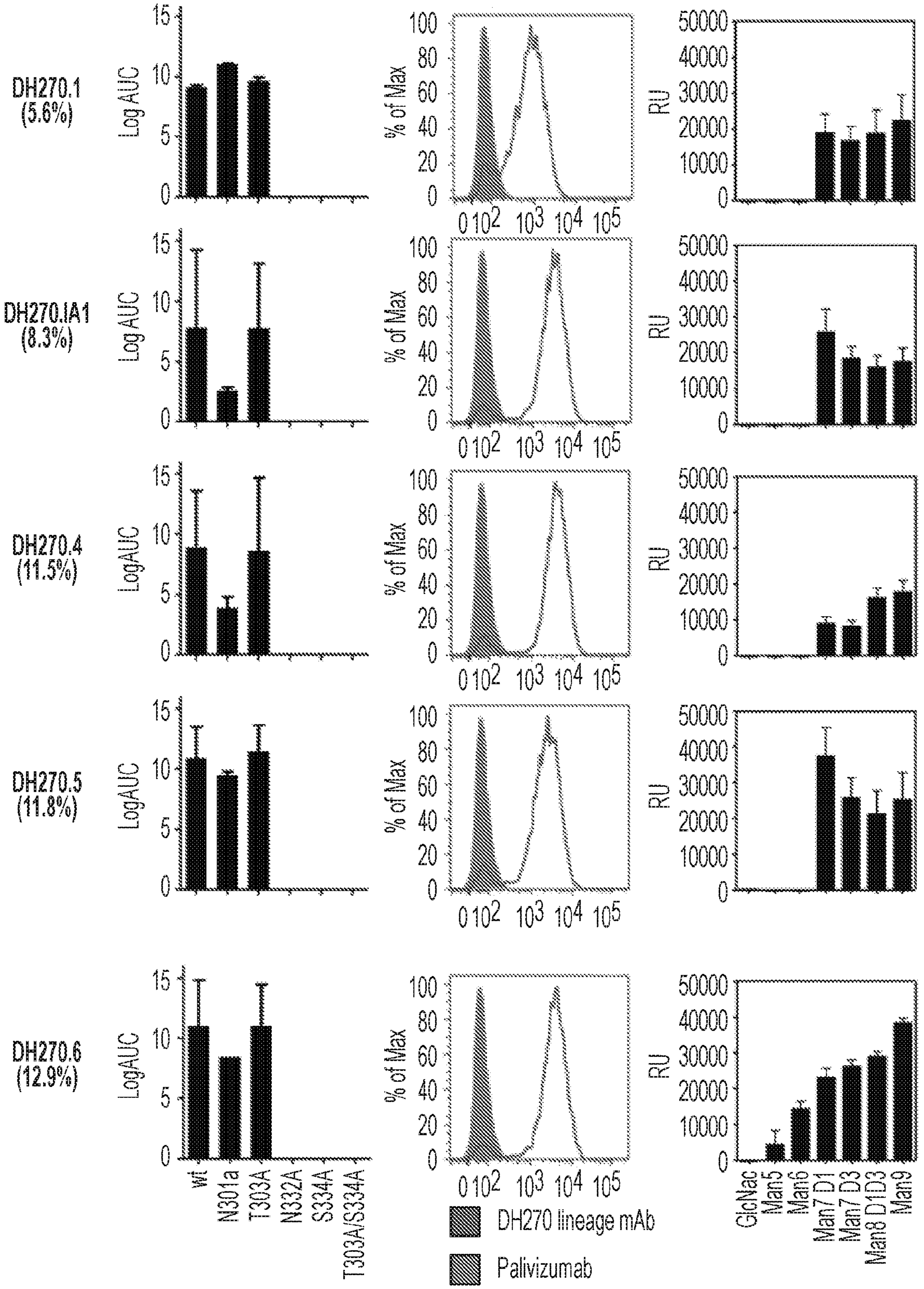
Figure 7B:
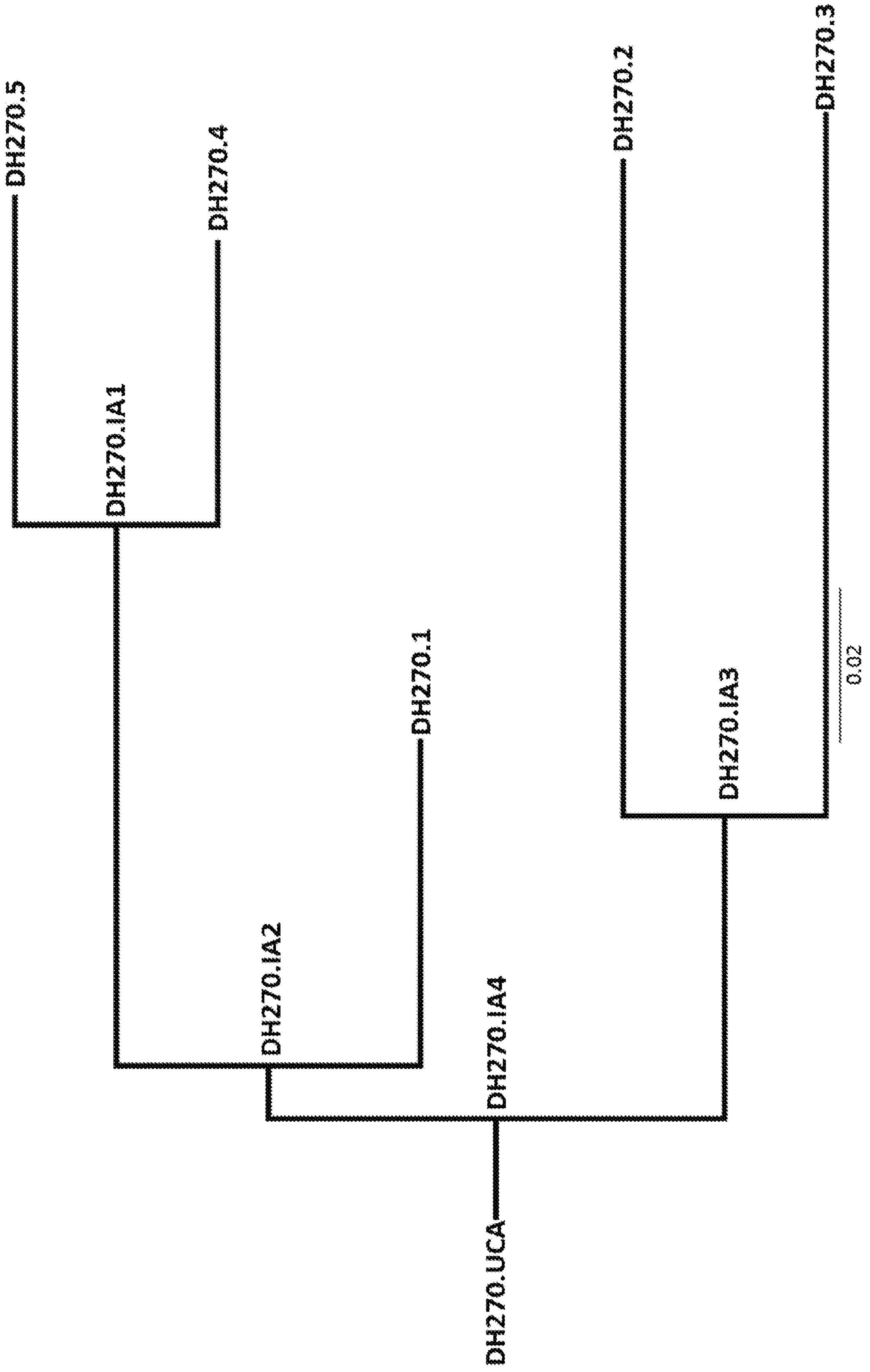
Figure 7C:
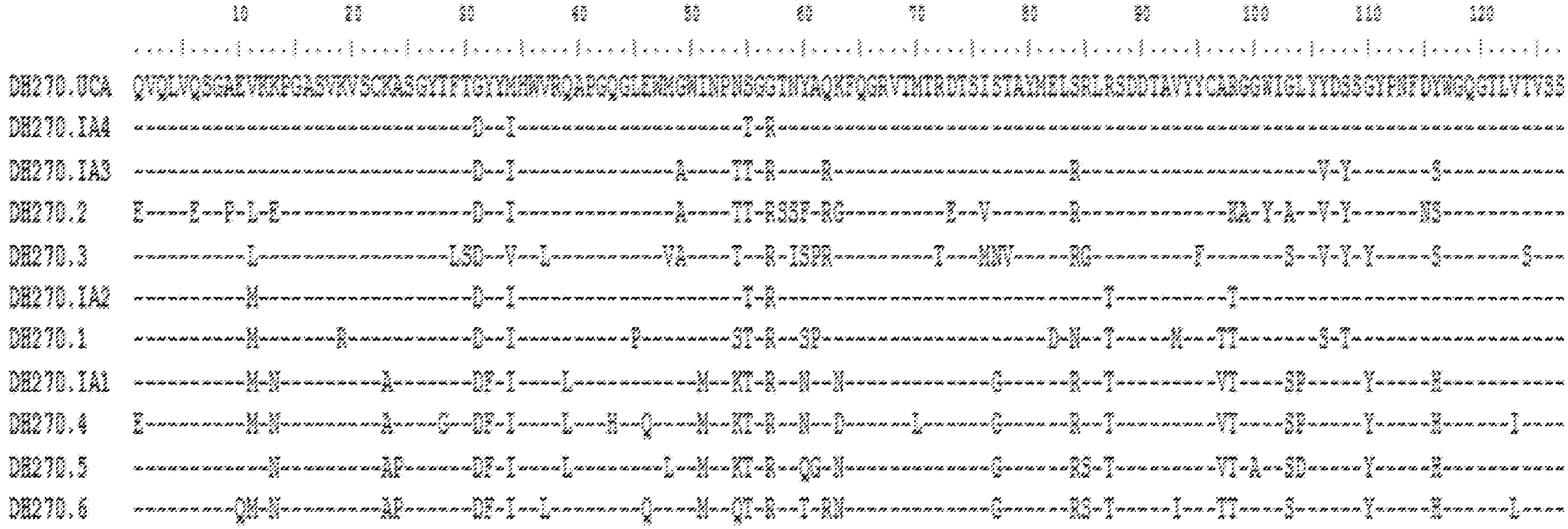
Figure 7D:
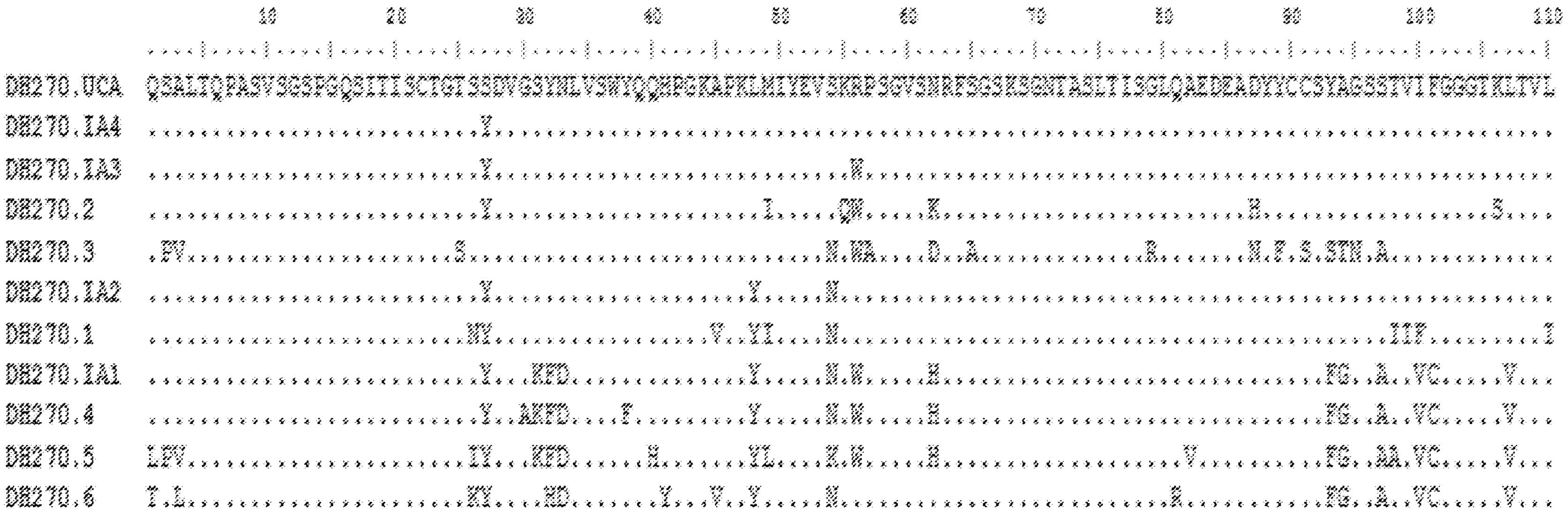

FIGS. 6A-B. DH270 lineage antibody binding to autologous CH848 Env components. (A) Binding of DH270 lineage antibodies (column) to 120 CH848 autologous gp120 Env glycoproteins (rows) grouped based on time of isolation (w: week; d: day; black and white blocks). The last three rows show the neutralization profile of the three autologous viruses that lost the PNG at position N332 (blue blocks). V1 aa length of each virus is color-coded as indicated. Antibody binding is measured in ELISA and expressed as log area under the curve (Log AUC) and color-coded based on the categories shown in the histogram. The histogram shows the distribution of the measured values in each category. The black arrow indicated Env 10.17. Viruses isolated at and after week 186, which is the time of first evidence of DH270 lineage presence, are highlighted in different colors according to week of isolation. (B) Left: Binding to CH848.TF mutants with disrupted N301 and/or N332 glycan sites. Results are expressed as Log AUC. $V_H$ mutation frequency is shown in parenthesis for each antibody (see also FIG. 7A). Middle: Binding to CH848 Env trimer expressed on the cell surface of CHO cells. Results are expressed as maximum percentage of binding and are representative of duplicate experiments. DH270 antibodies are shown in red. Palivizumab is the negative control (gray area). The curves indicate binding to the surface antigen on a 0 to 100 scale (y-axis), the highest peak between the test antibody and the negative control sets the value of 100. Right: Binding to free glycans measured on a microarray. Results are the average of background-subtracted triplicate measurements and are expressed in RU. FIGS. 2A-D.

Figure 1A:
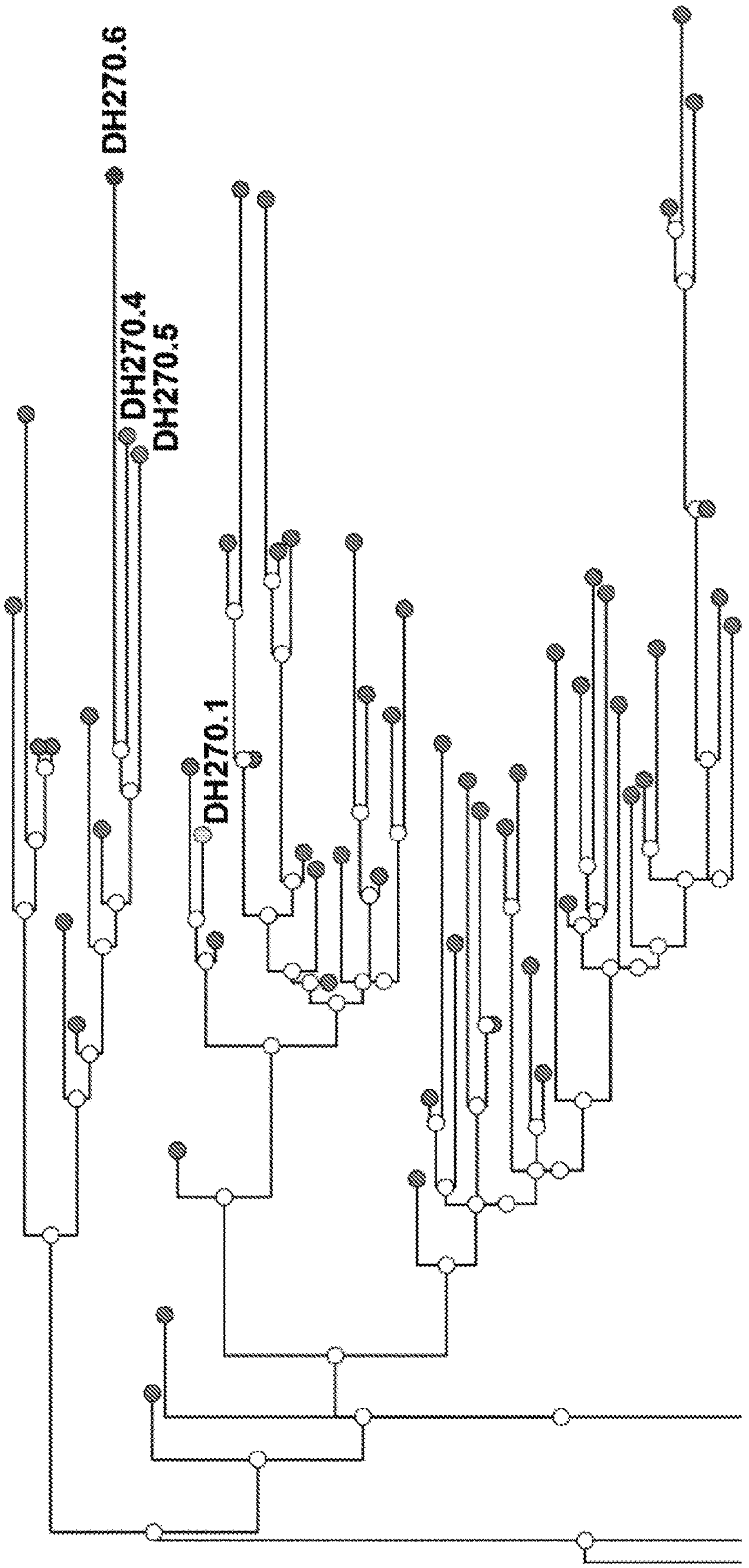
FIGS. 1A-B. DH270 lineage with time of appearance and neutralization by selected members. (A) Phylogenetic relationship of 6 mAbs and 93 NGS $V_HDJ_H$ sequence reads in the DH270 clonal lineage. External nodes (filled circles) represent $V_HDJ_H$ nucleotide sequences of either antibodies retrieved from cultured and sorted memory B cells (labeled) or a curated dataset of NGS $V_HDJ_H$ rearrangement reads (unlabeled). Coloring is by time of isolation. Samples from week 11, 19, 64, 111, 160, 186 and 240 were tested and time-points from which no NGS reads within the lineage were retrieved are reported in FIGS. 30A-C. Internal nodes (open circles) represent inferred ancestral intermediate sequences. Units for branch-length estimates are nucleotide substitution per site. (B) Neutralization dendrograms display single mAb neutralization of a genetically diverse panel of 207 HIV-1 isolates. Coloring is by $IC_{50}$. See also FIG. 33.
Figure 1A:
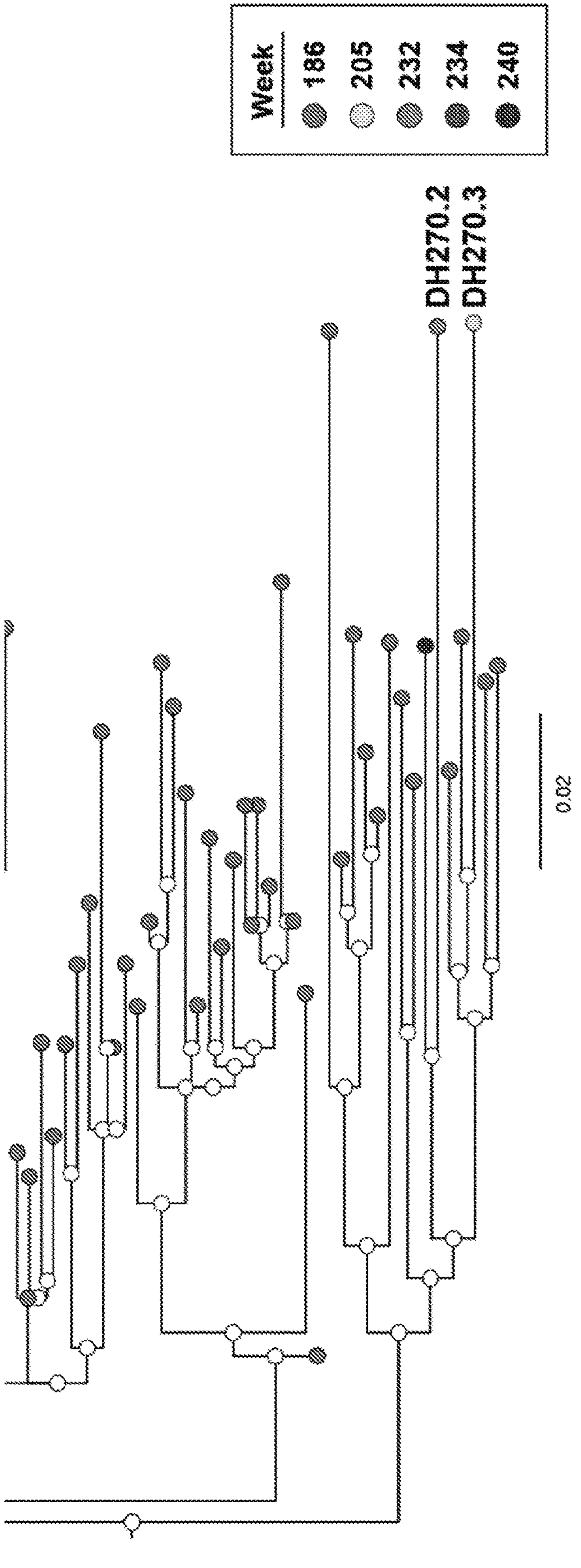

FIGS. 7A-D. Characteristics of DH270 lineage monoclonal antibodies. (A) Immunogenetics of DH270 lineage monoclonal antibodies. (B) Phylogenetic relationship of $V_HDJ_H$ rearrangements of the unmutated common ancestor (DH270.UCA) and maturation intermediates DH270.IA1 through DH270.IA4 inferred from mature antibodies DH270.1 through DH270.5. DH270.6 was not included and clusters close to DH270.4 and DH270.5 as shown in FIG. 1. (C) Amino acid alignment of the $V_HDJ_H$ rearrangements of the inferred UCA and intermediate antibodies and DH270.1 through DH270.6 mature antibodies (SEQ ID NOS 62-72, respectively, in order of appearance). (D) Amino acid alignment of VLJL rearrangements of the inferred UCA and intermediate antibodies and DH270.1 through DH270.6 mature antibodies (SEQ ID NOS 73-83, respectively, in order of appearance). For DH270.6, all experimental data presented in this manuscript were obtained using the light chain sequence reported here. The light chain sequence of DH270.6 was subsequently revised to amino acids Q and A in positions 1 and 3 (instead of T and L). This difference did not affect neutralization and binding of DH270.6.

Figure 8B:
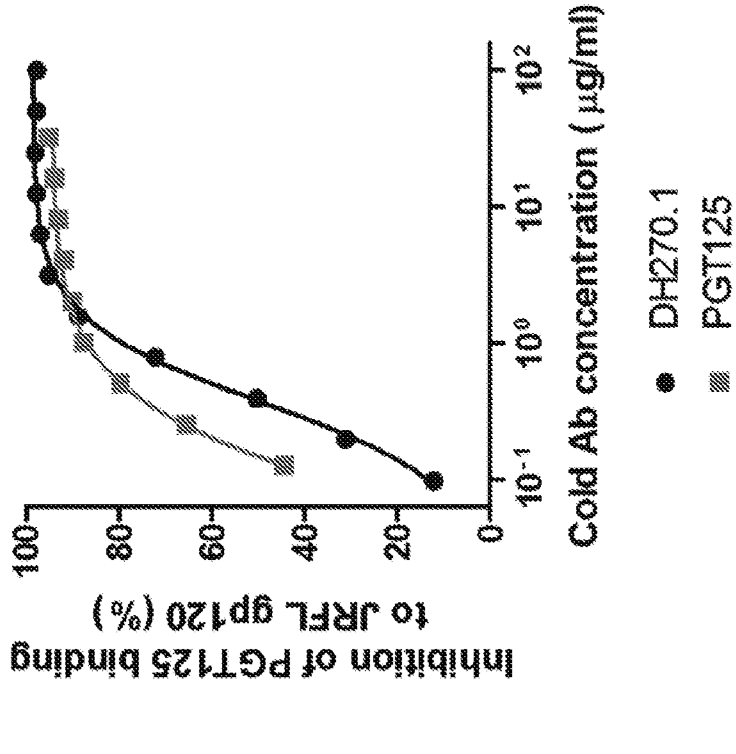
Figure 8C:
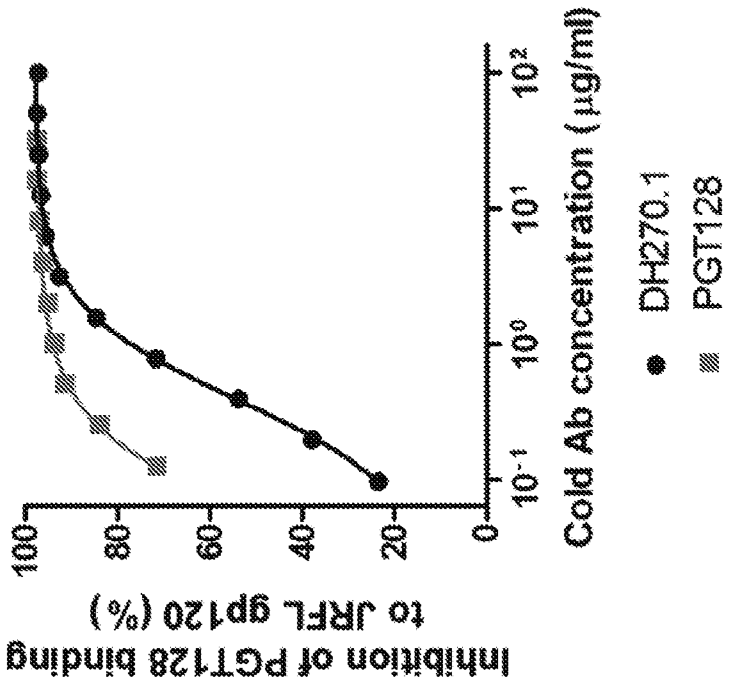

FIGS. 8A-C. DH270 lineage displays a N332-dependent V3 glycan bnAb functional profile. (A) DH270 antibody lineage neutralization of five HIV-1 pseudoviruses and respective N332A mutants. Data are expressed as IC50 g/ml. Positivity <10 μg/ml is shown in bold. (B, C) DH270.1 ability to compete gp120 Env binding of V3 glycan bnAbs PGT125 and PGT128. Inhibition by cold PGT125 or PGT128 (grey line) was used as control (see Methods).

FIGS. 9A-D. DH475 and DH272 are strain-specific, N332-glycan dependent antibodies. (A) Phylogenetic trees of DH475 (top) and DH272 (bottom) clonal lineages. External nodes (filled circles) representing $V_HDJ_H$ observed sequences retrieved from cultured and sorted memory B cells (labeled) or NGS antibody sequences (unlabeled) are colored according to time point of isolation. Internal nodes (open circles) represent inferred ancestral intermediate sequences. Branch length estimates units are nucleotide substitution per site. (B) Immunogenetics of DH475 and DH272 monoclonal antibodies; (C) Binding of DH475 (top) and DH272 (bottom) monoclonal antibodies to wild-type CH848TF gp120 Env (wild-type (wt), on the x-axis, and mutants with disrupted the 301 and/or 332 N-linked glycosylation sites. Results are expressed as Log AUC. (D) Heterologous neutralization profile of DH475 and DH272 monoclonal antibodies expressed as IC50 μg/ml on a multiclade panel of 24 viruses. White square indicates IC50>50 μg/ml, the highest antibody concentration tested. Clades are reported on the left and virus identifiers on the right. DH475 neutralized no heterologous viruses and DH272 neutralized one Tier 1 heterologous virus.

Figure 10:
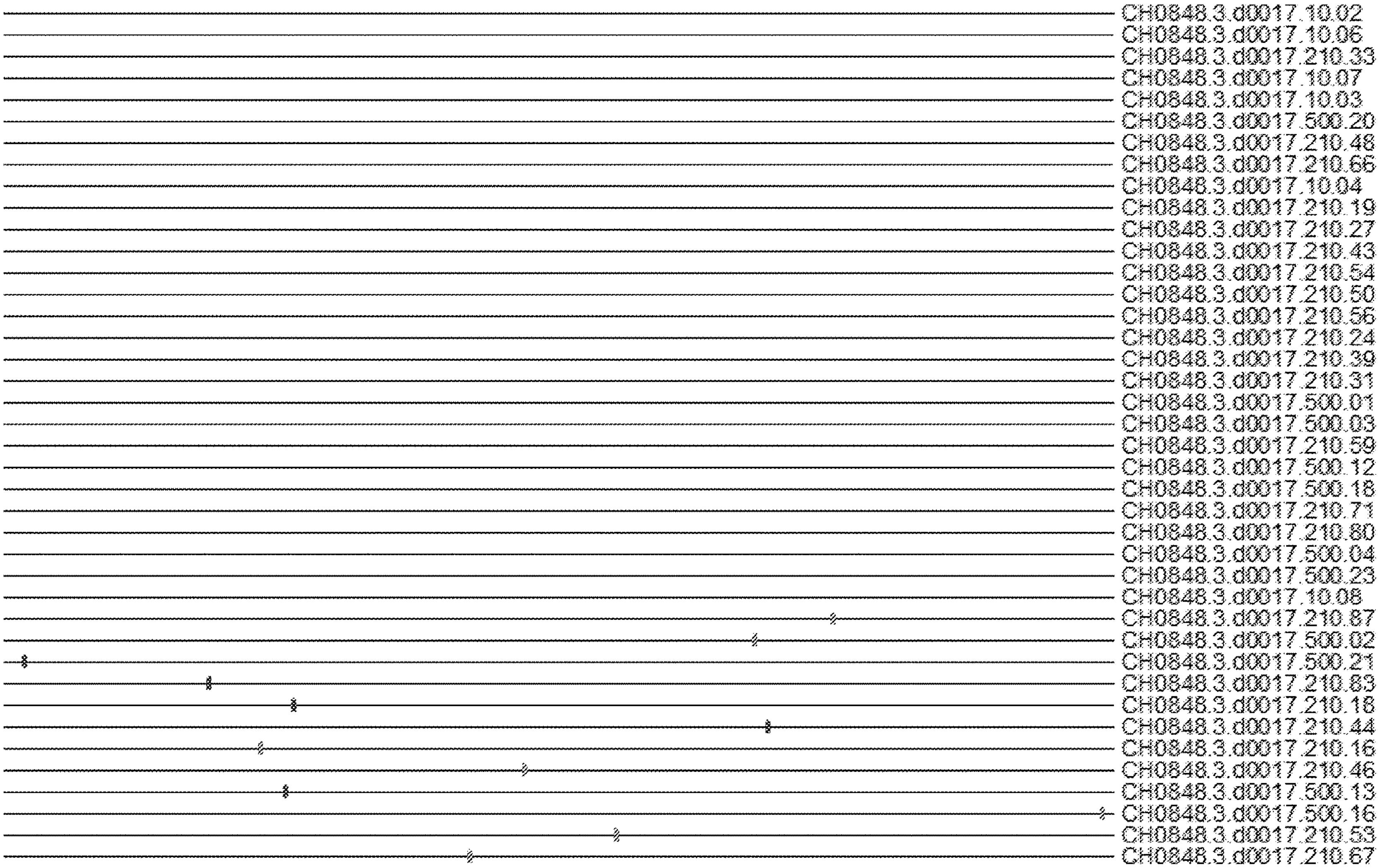
Figure 10:
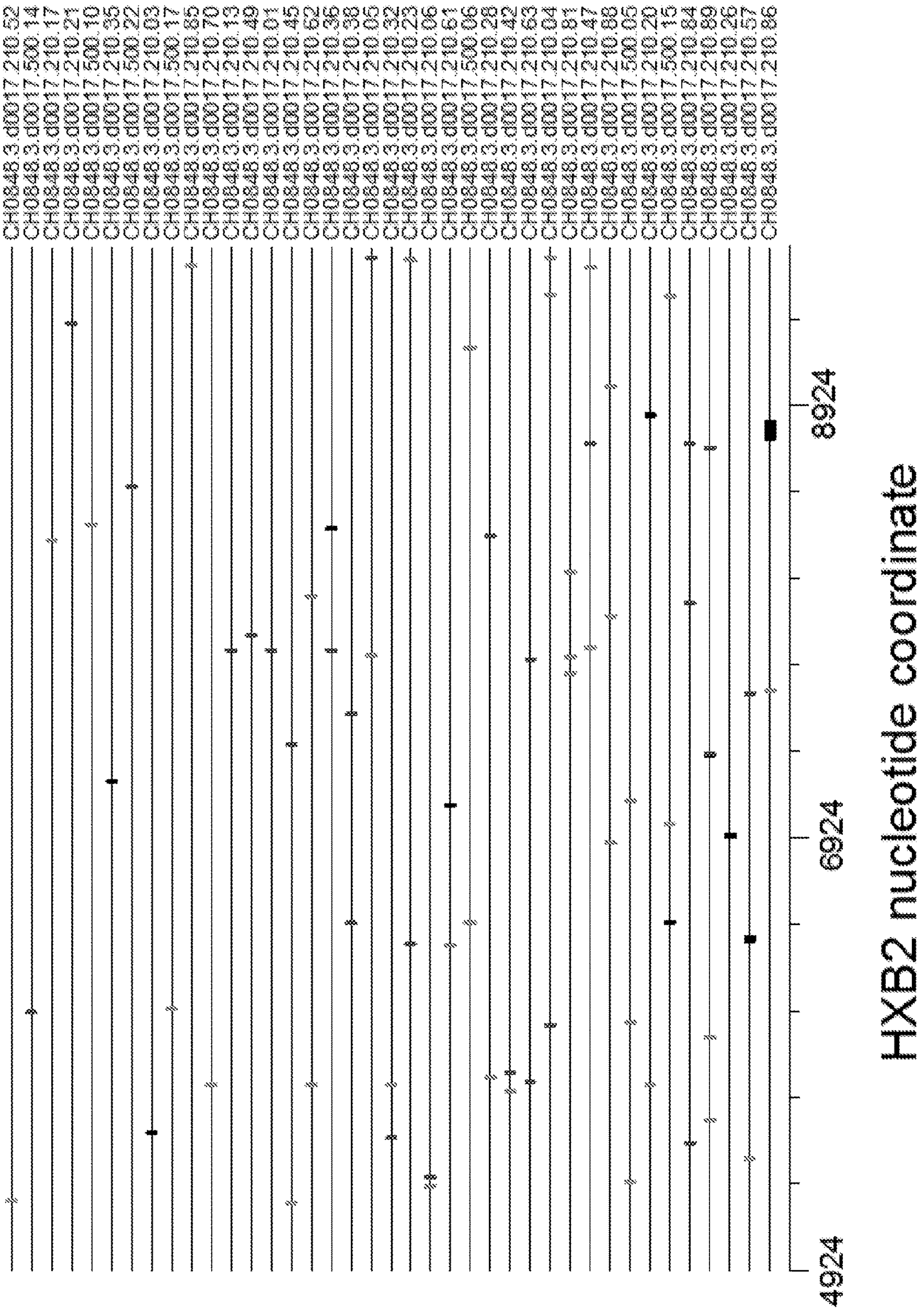

FIG. 10. CH848 was infected by a single transmitted founder virus. 79 HIV-1 3' half single genome sequences were generated from screening timepoint plasma. Depicted is a nucleotide Highlighter plot (www.hiv.lanl.gov/content/sequence/HIGHLIGHT/HIGHLIGHT_XYPLOT/highlighter.html). Horizontal lines represent single genome sequences and tic marks denote nucleotide changes relative to the inferred TF sequence (key at top, nucleotide position relative to HXB2).

Figures 11A, 11B:
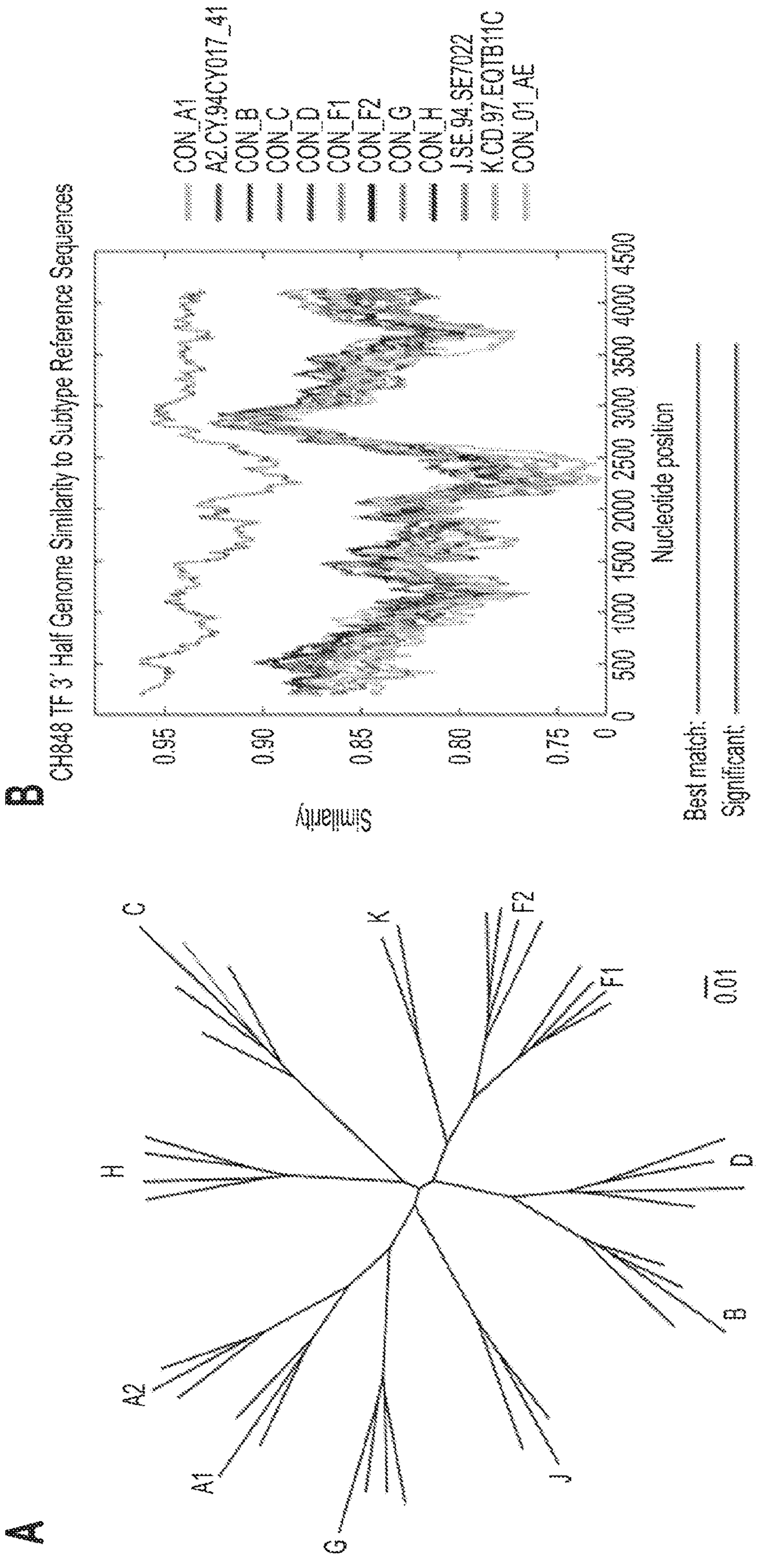

FIGS. 11A-B. CH848 was infected by a subtype C virus. (A) PhyML was used to construct a maximum likelihood phylogenetic tree comparing the CH848 transmitted founder virus to representative sequences from subtypes A1, A2, B, C, D, F1, F2, G, H, and K (substitution model: GTR+I+G, scale bar bottom right). The CH848 TF sequence in the subtype C virus cluster is shown in red. (B) Similarity to each subtype reference sequence is plotted on the y-axis and nucleotide position is plotted the x-axis (window size=400 nt, significance threshold=0.95, key to right). The two bars below the x-axis indicate which reference sequence is most similar to the CH848 TF sequence ("Best Match") and whether this similarity is statistically significant relative to the second best match ("Significant").

Figure 12:
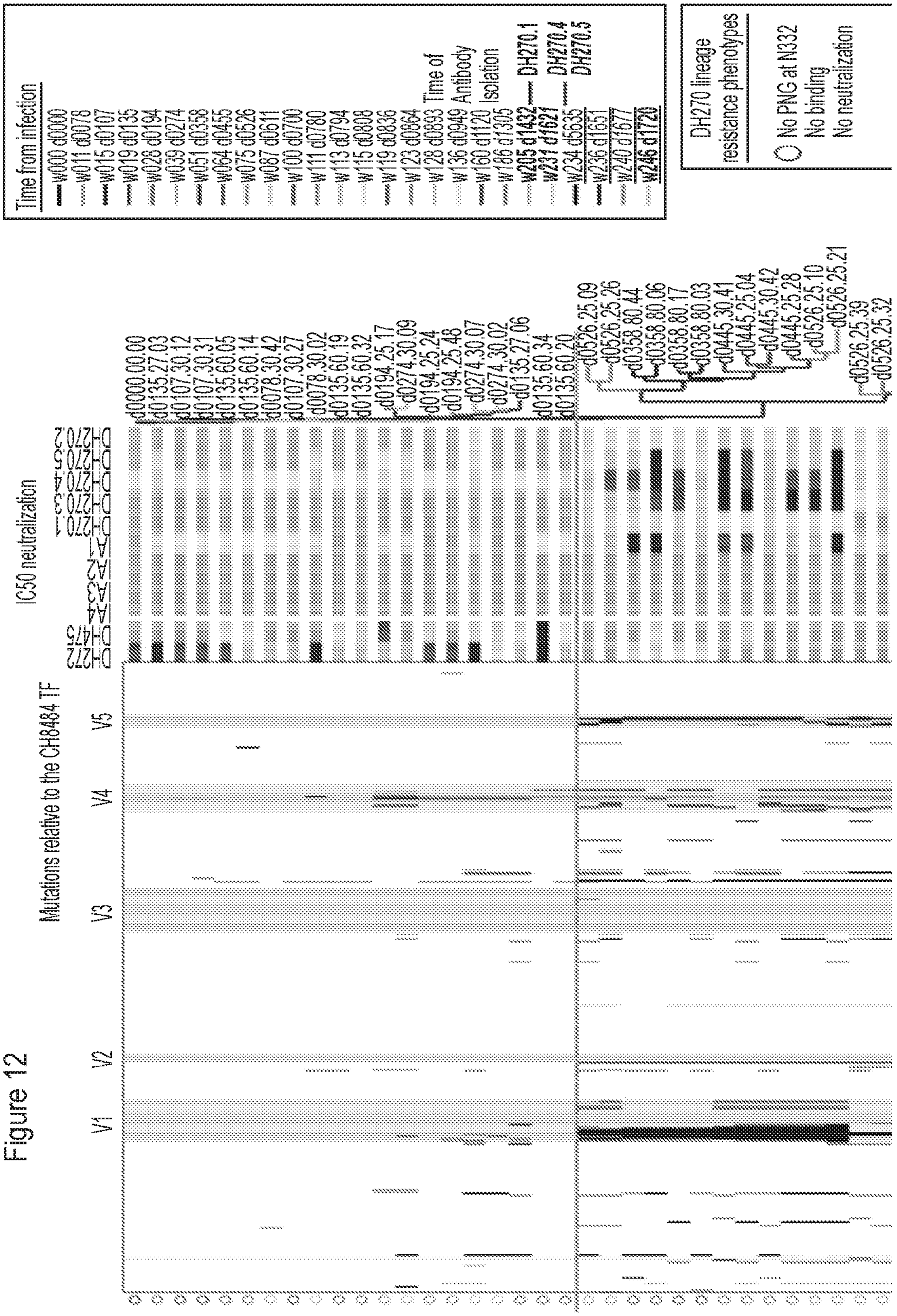
Figure 12:
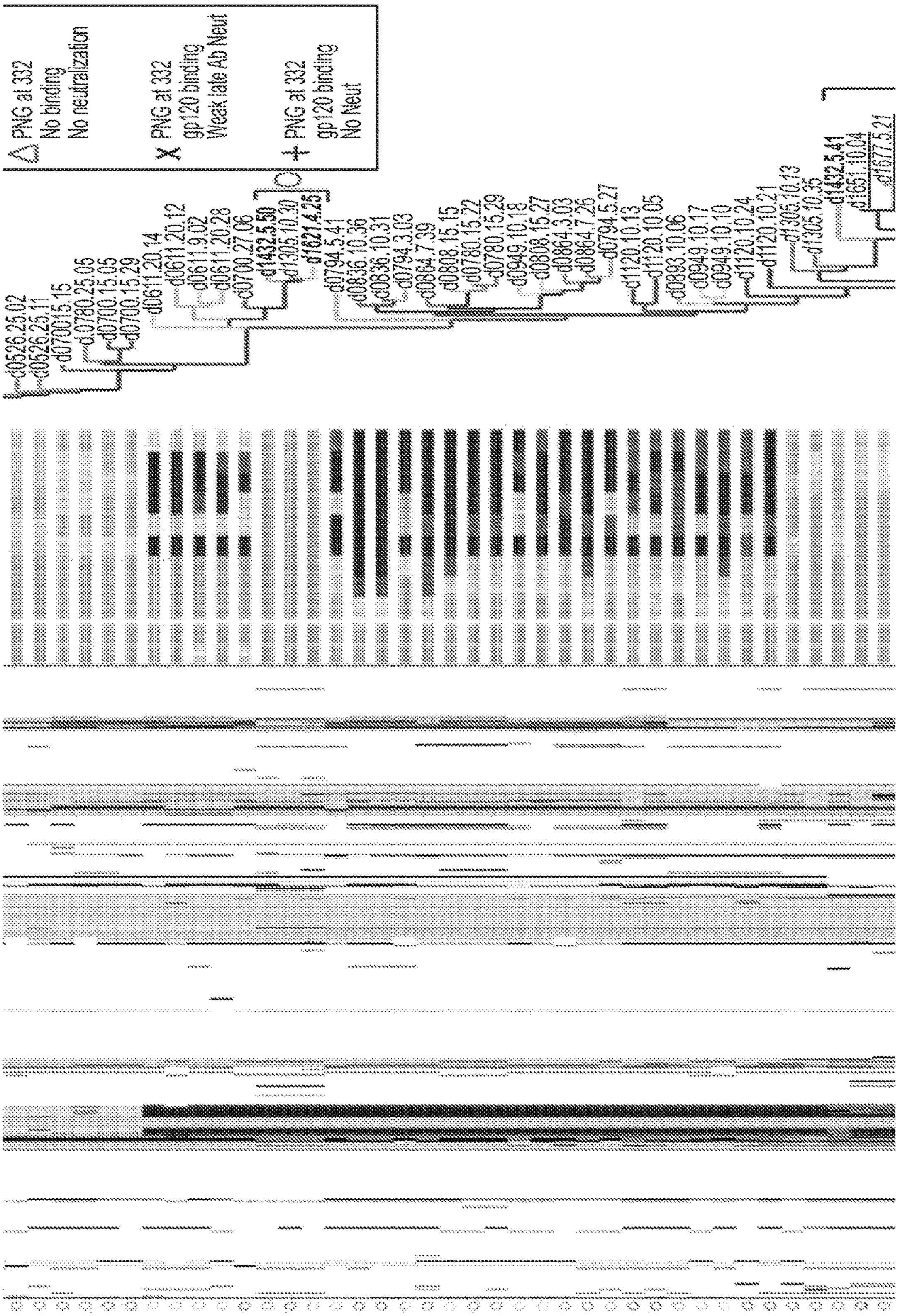
Figure 12:
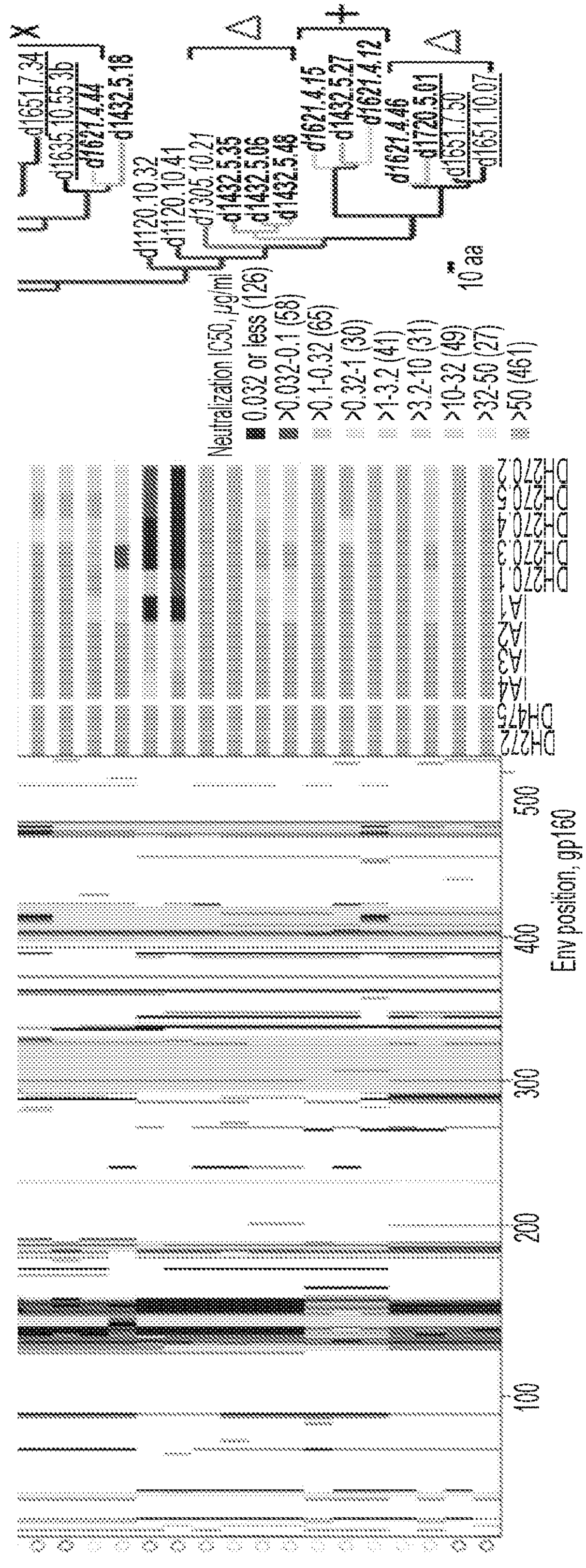

FIG. 12. Co-evolution of CH848 autologous virus and N332-dependent V3 glycan antibody lineages DH272, DH475 and DH270. Mutations relative to the CH848 TF virus in the alignment of CH848 sequences with accompanying neutralization data (Insertion/deletions=black. Substitutions: red=negative charge; blue=positive charge; cyan=PNG sites) (43). The green line indicates the transition between DH272/DH475 sensitive and DH270 lineage sensitive virus immunotypes at day 356 (week 51). Viruses isolated after week 186, time of first evidence of DH270 lineage presence, are highlighted in different colors according to week of isolation.

Figure 13A:
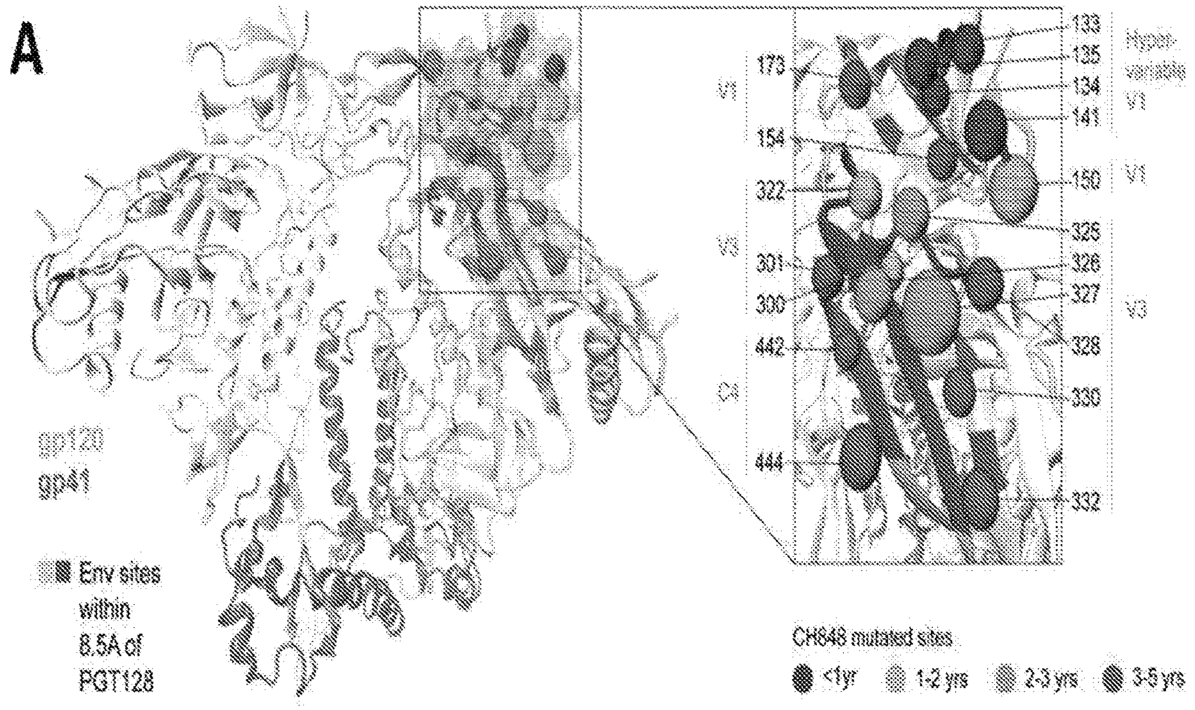
Figure 13B:
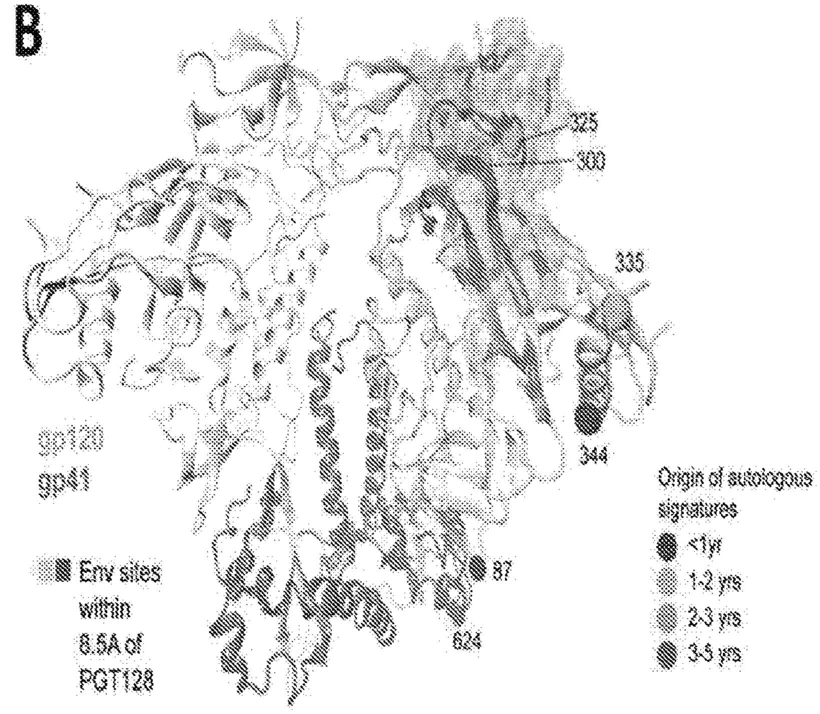

FIGS. 13A-B. Mutations in CH848 Env over time. (A) Variable positions that are close to the PGT128 epitope in a trimer structure (PDB ID: 4TVP) (13) are represented by spheres color-coded by the time post-infection when they first mutate away from the CH848 TF sequence. The PGT128 antibody structure (PDB ID: 5C7K) (29) was used as a surrogate for DH270, as a high resolution structure is not yet available for DH270. Env positions with either main chain, side chain or glycans within 8.5 Å of any PGT128 heavy atom are shown in yellow surface and brown ribbon representations. Time of appearance of mutations are color coded as indicated. (B) Same as (A) for mutating Env sites that were autologous antibody signatures of antibody sensitivity and resistance.

Figure 14:
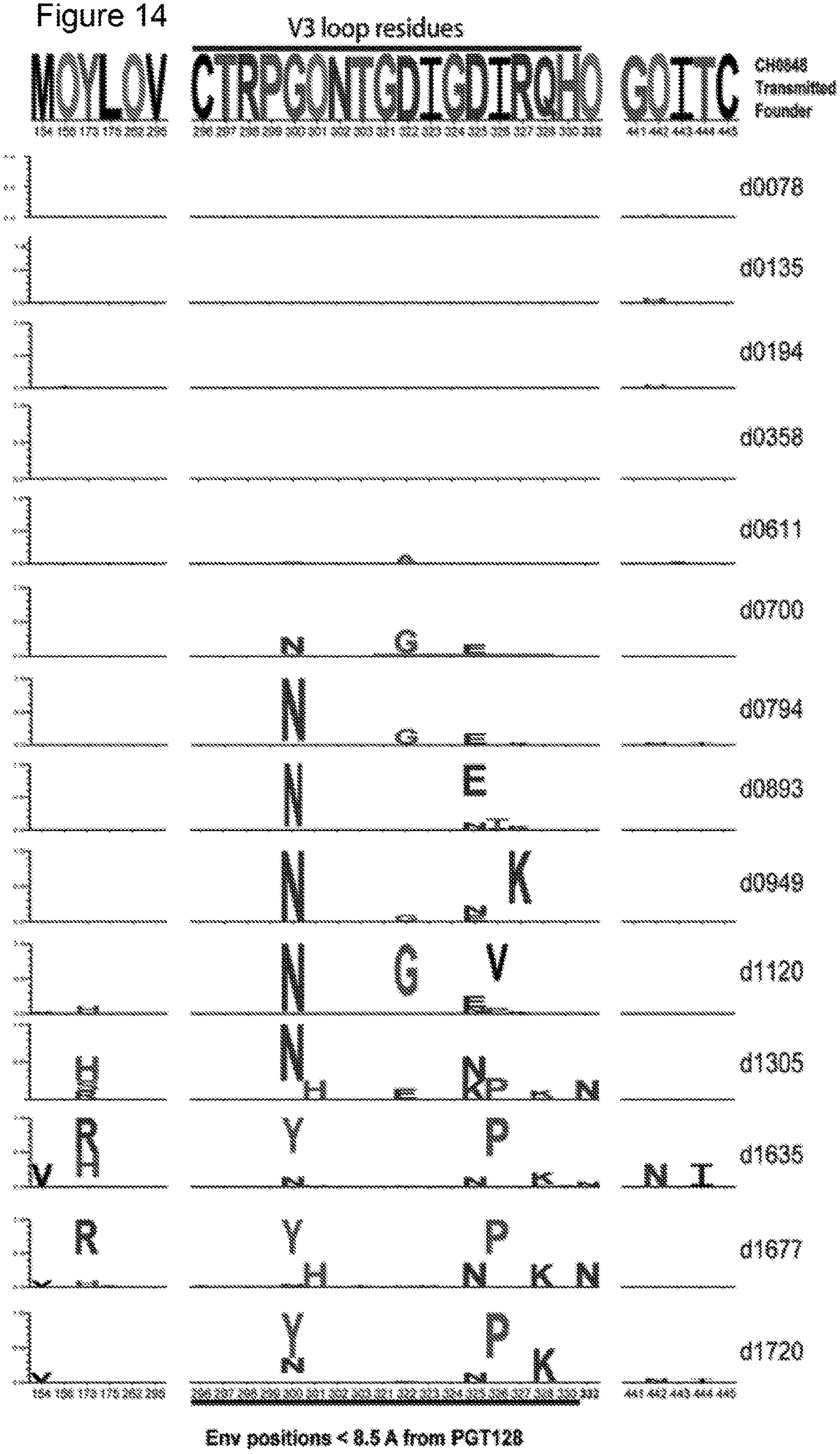

FIG. 14. Accumulation of amino acid mutations in CH848 virus over time. This figure shows all of the readily aligned positions near the contact site of V3 glycan antibodies in FIGS. 13A-B, (excluding amino acids that are embedded in the V1 hypervariable regions). The magenta O is a PNG site, whereas an N is an Asn that is not embedded in a glycosylation site. The logo plots represent the frequency of amino acids at each position, and the TF amino acid is left blank to highlight the differences over time.

Figure 15:
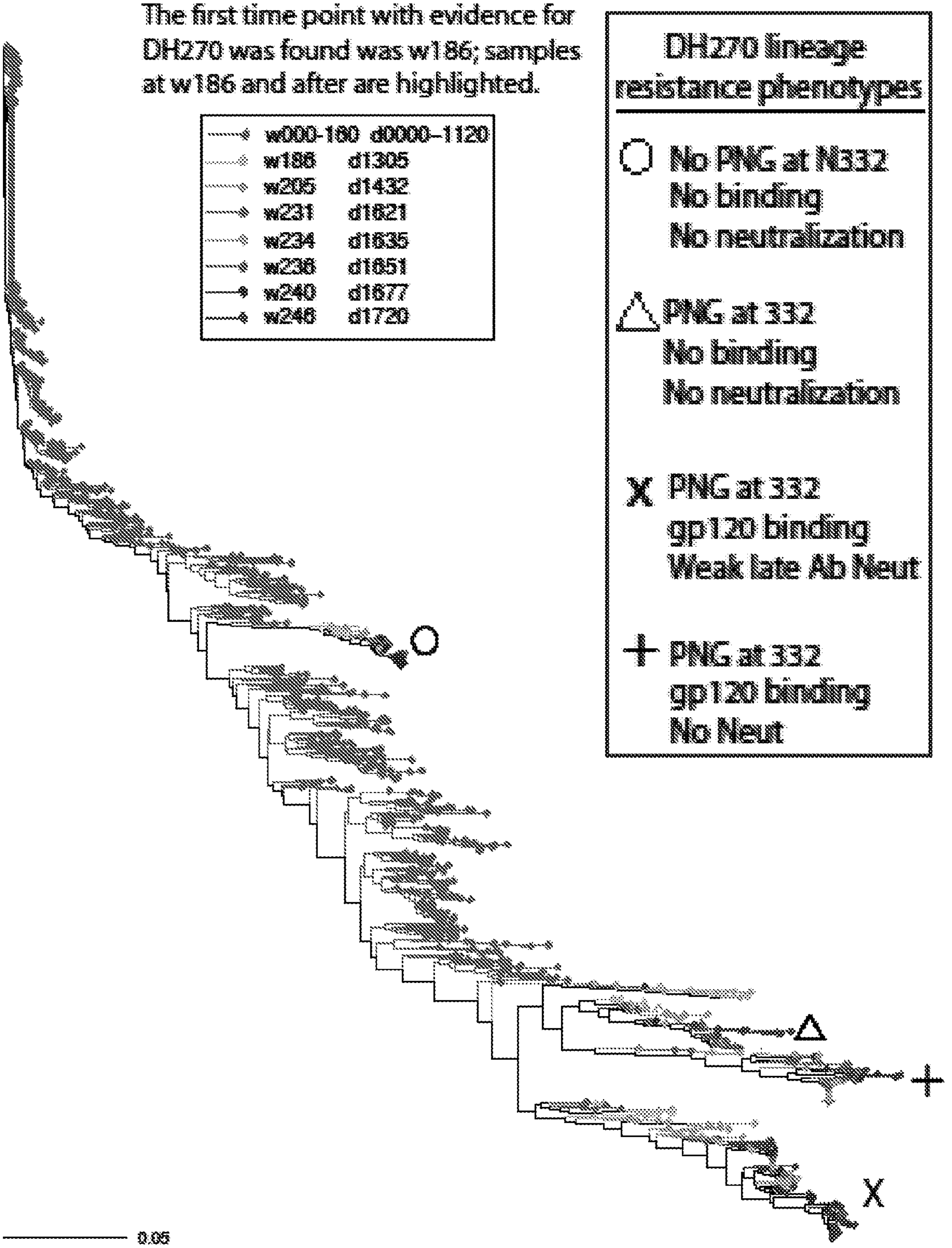

FIG. 15. CH848 virus lineage maximum likelihood phylogenetic tree rooted on the transmitted founder sequence. The phylogenetic tree shows 1,223 Env protein sequences translated from single genome sequences. Sequences sampled prior to the development of Tier 2 heterologous breadth (week 186) are shaded in grey and sequences from after week 186 are highlighted using the color scheme from FIG. 12. Four viral clades with distinct DH270 lineage phenotypes are indicated with a circle, triangle, cross and "X", respectively.

FIGS. 16A-F. Inverse-correlation between the potency of V3 glycan broadly neutralizing antibodies and V1 length shown for the full panel of 207 viruses. Correlation between neutralization potency (y-axis) and V1 length of the respective viruses (x-axis, n=207) of DH270 lineage bnAbs DH270.1 (A), DH270.5 (B), DH270.6 (C) and V3 glycan bnAbs 10-1074 (D), PGT121 (E) and PGT128 (F) isolated from other individuals. Correlation p-values are non-parametric two sided, Kendall's tau. Slopes show linear regression.

Figure 17A:
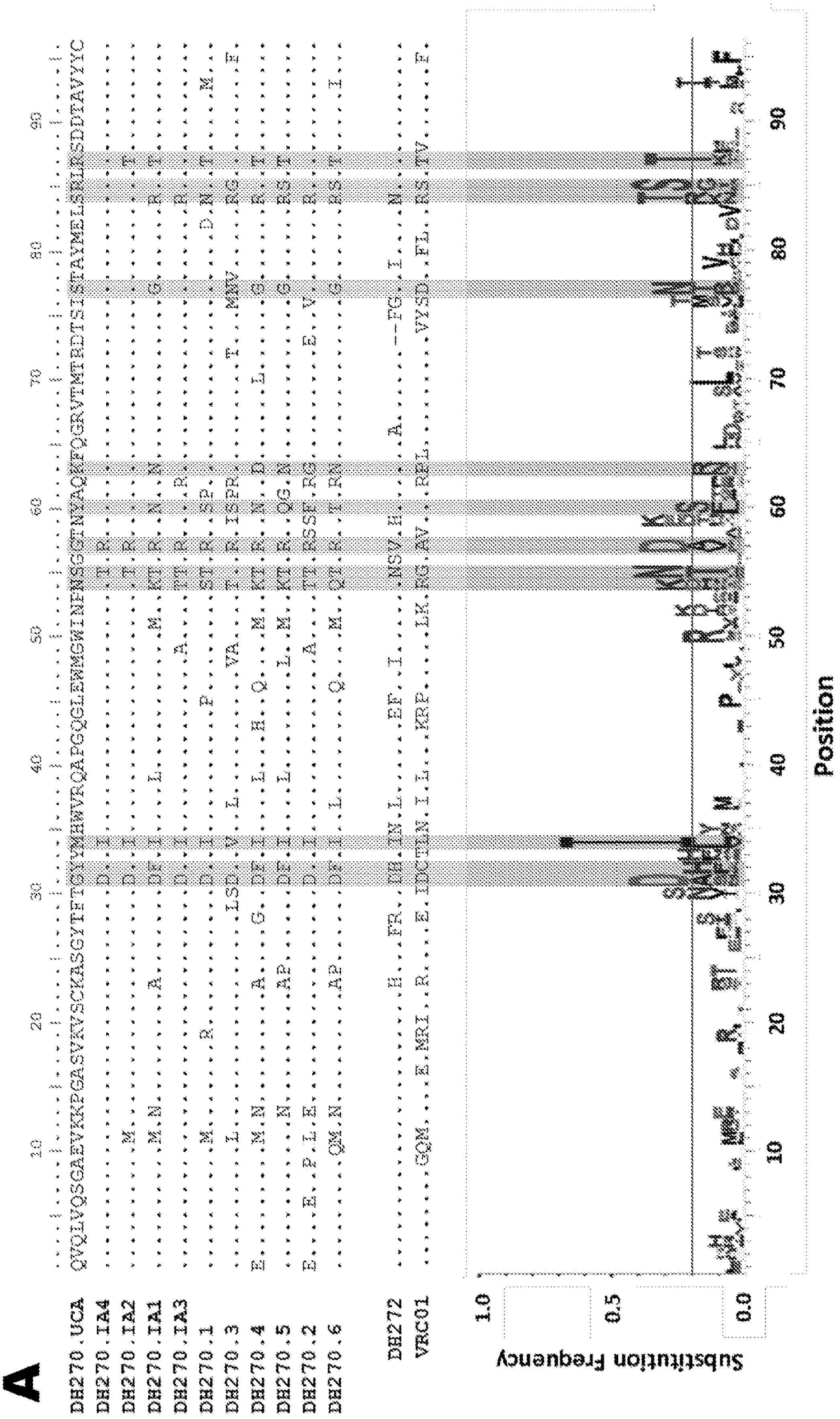

FIGS. 17A-B. Role of $V_H$1-2*02 intrinsic mutability in determining DH270 lineage antibody somatic hypermutation. (A) The sequence logo plot shows the frequency of VH1-2*02 amino acid (aa) mutations from germline at each position, calculated from an alignment of 10,995 VH1-2*02 reads obtained from 8 HIV-1 negative individuals by NGS that replicated across two independent Illumina experiments (35). The logo plot shows the frequency of mutated aa at each position. The red line indicates the threshold of mutation frequency (20%) used to define frequently mutated aa. The VH aa sequences of DH270 lineage antibodies, DH272 and VRC01 are aligned on the top. The 12 red vertical stripes indicate frequently mutated aa that were also frequently mutated (>25% of the VH sequences of isolated antibodies) in the DH270 lineage. Figure discloses SEQ ID NOS 84-96, respectively, in order of appearance. (B) VH aa encoded by VH1-2 sequences from genomic DNA aligned to DH270 lineage antibodies aa sequences (see "Sequencing of germline variable region from genomic DNA" in Methods). Figure discloses SEQ ID NOS 97-109, respectively, in order of appearance.

Figure 18A:
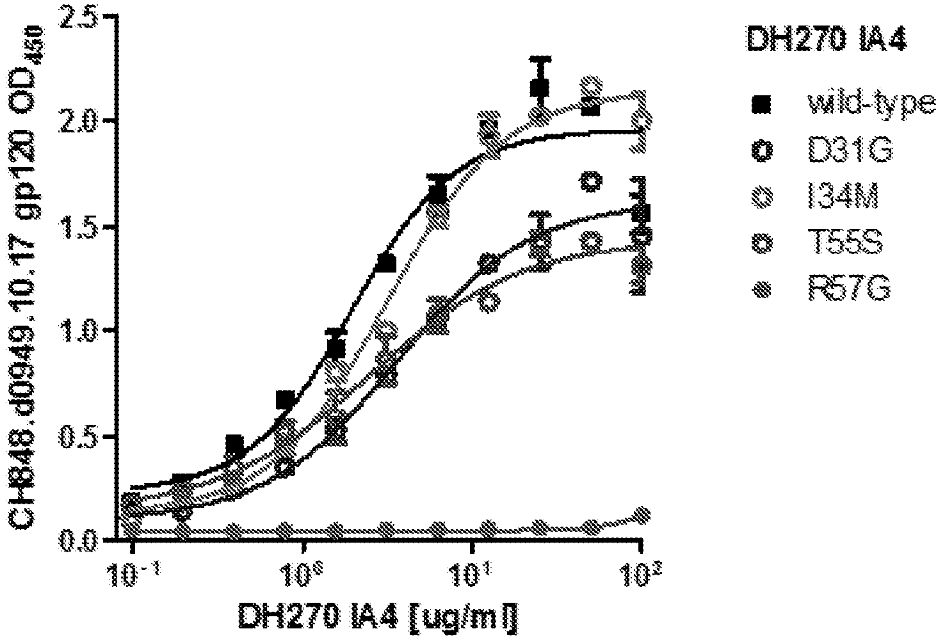
Figure 18B:
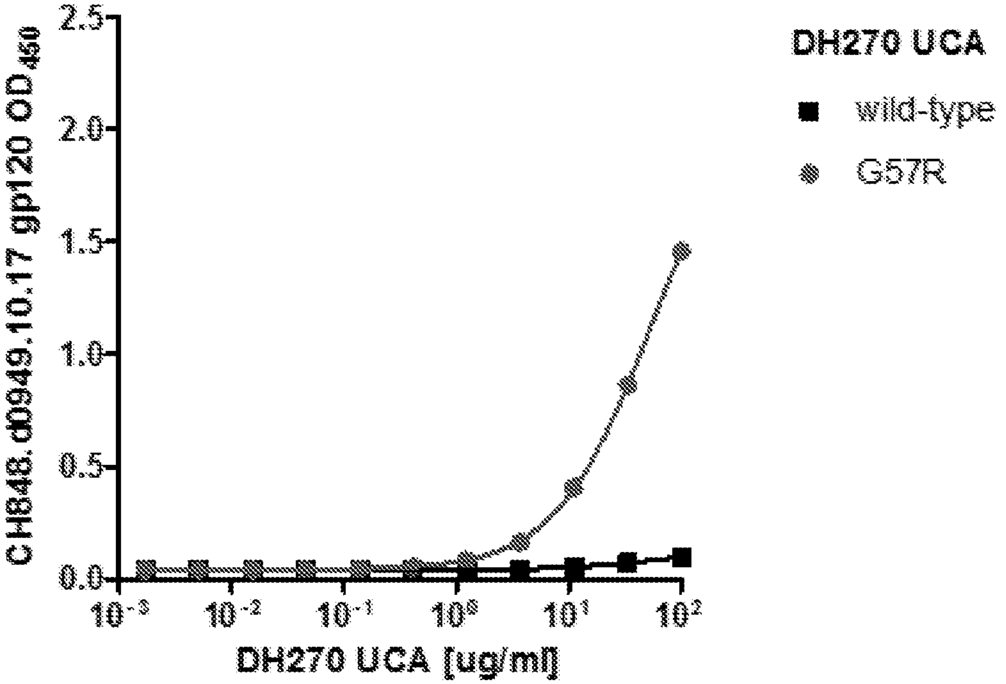

FIGS. 18A-B. Effect of the G57R mutation on DH270.IA4 and DH270.UCA binding to Env 10.17 gp120. (A) Binding to Env 10.17 gp120 by wild-type DH270.IA4 (black) and DH270.IA4 variants in which each mutated aa was reverted to germline (D31G, blue; I34M, orange; T55S, green, R57G, red). Mean and standard deviation from duplicate observations are indicated for each datapoint and curve fitting (non-linear, 4-parameters) is shown for each dataset. Binding is quantified as background subtracted OD450 values. (B) Binding to Env 10.17 by wild-type DH270.UCA (black) and the DH270.UCA with the G57R mutation (red).

Figure 19:
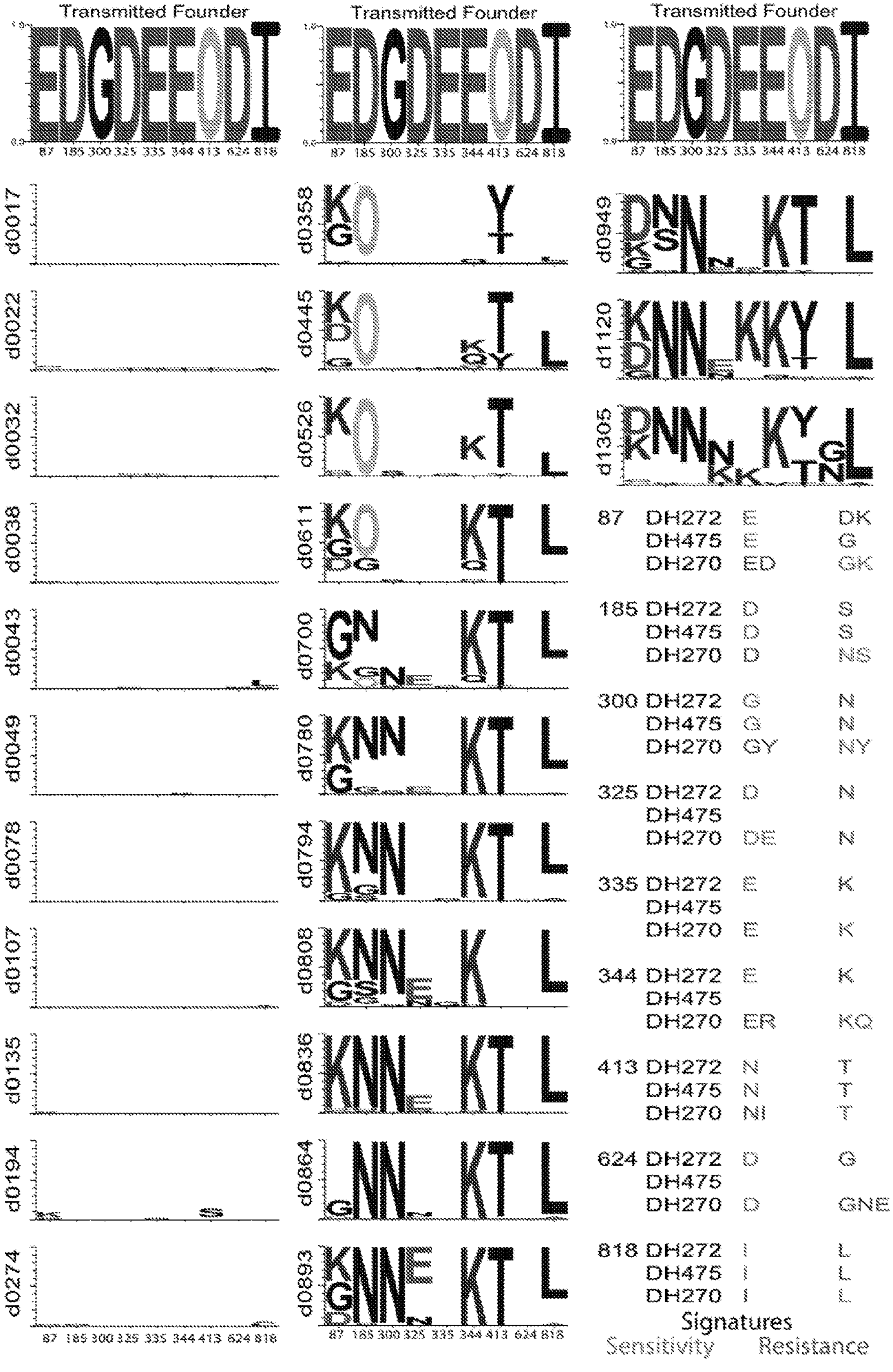

FIG. 19. Virus signature analysis. Logo plots represent the frequency of amino acids mutations in CH848 virus quasispecies from transmitted founder at indicated positions over time. Red indicates a negatively charged amino acid, blue positive, black neutral; the light blue O is a PNG site. The signatures outlined in detail in FIG. 36 are summarized in the bottom right column where a red amino acid is associated with resistance to the antibody on the right, a blue amino acid is associated with sensitivity.

FIGS. 20A-F. Autologous Env V1 length associations with DH270 lineage neutralization and gp120 binding. Eighty-two virus Envs—the subset from FIGS. 34-35 that were assayed for both neutralization (A-C) and binding (D-F) to DH270.1, DH270.4 and DH270.5—were evaluated. The 3 Envs that had lost the PNG site at N332 were not included, as they were negative for all antibodies tested independently of V1 length. Only points from positive results are plotted: IC50<50 μg/ml for neutralization in panels A-C, and AUC>1 for binding in panels D-F. N is the number of positive sample.

Figure 21C:
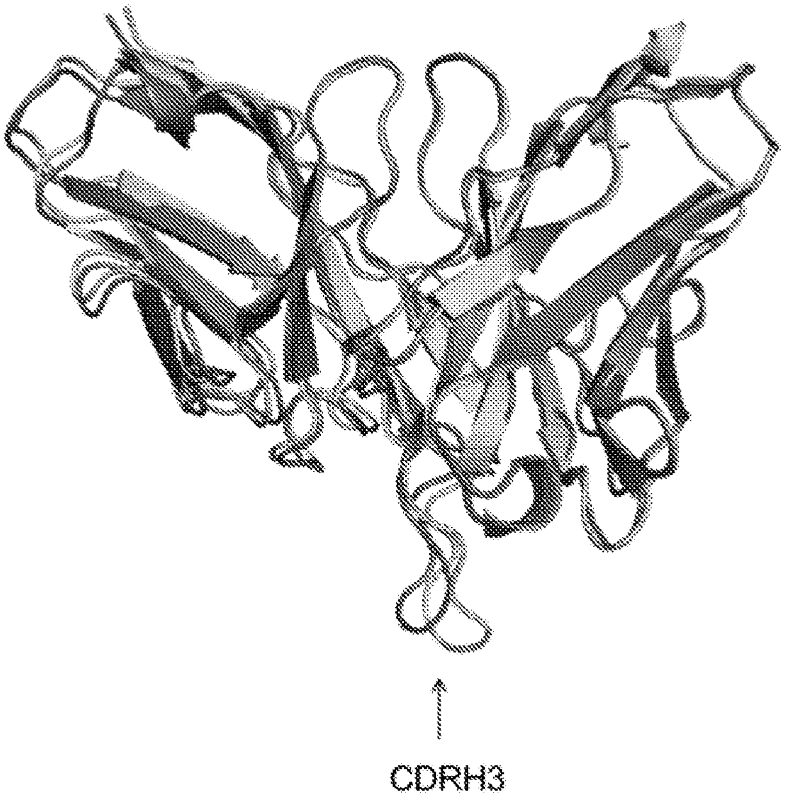

FIGS. 21A-C. Sequence and structural comparison of DH270.UCA1 and DH270.UCA3. Sequence alignments of UCA3 and UCA1. (A) Heavy chains (SEQ ID NOS 110-112, respectively, in order of appearance) and (B) light chains (SEQ ID NOS 113-114, respectively, in order of appearance), whose structures were obtained in this study, are aligned with UCA4, the germline antibody for the DH270 lineage (DH270.UCA). The UCA3 and UCA4 light chains are identical. Asterisks indicate positions in which the amino acids are the same. Colon ":", period "." and blanks " " correspond to strictly conserved, conserved and major differences, respectively. (C) Superposition of UCA3 (cyan) and UCA1 (gray). Structural differences in CDR regions are indicated with an arrow.

Figure 22:
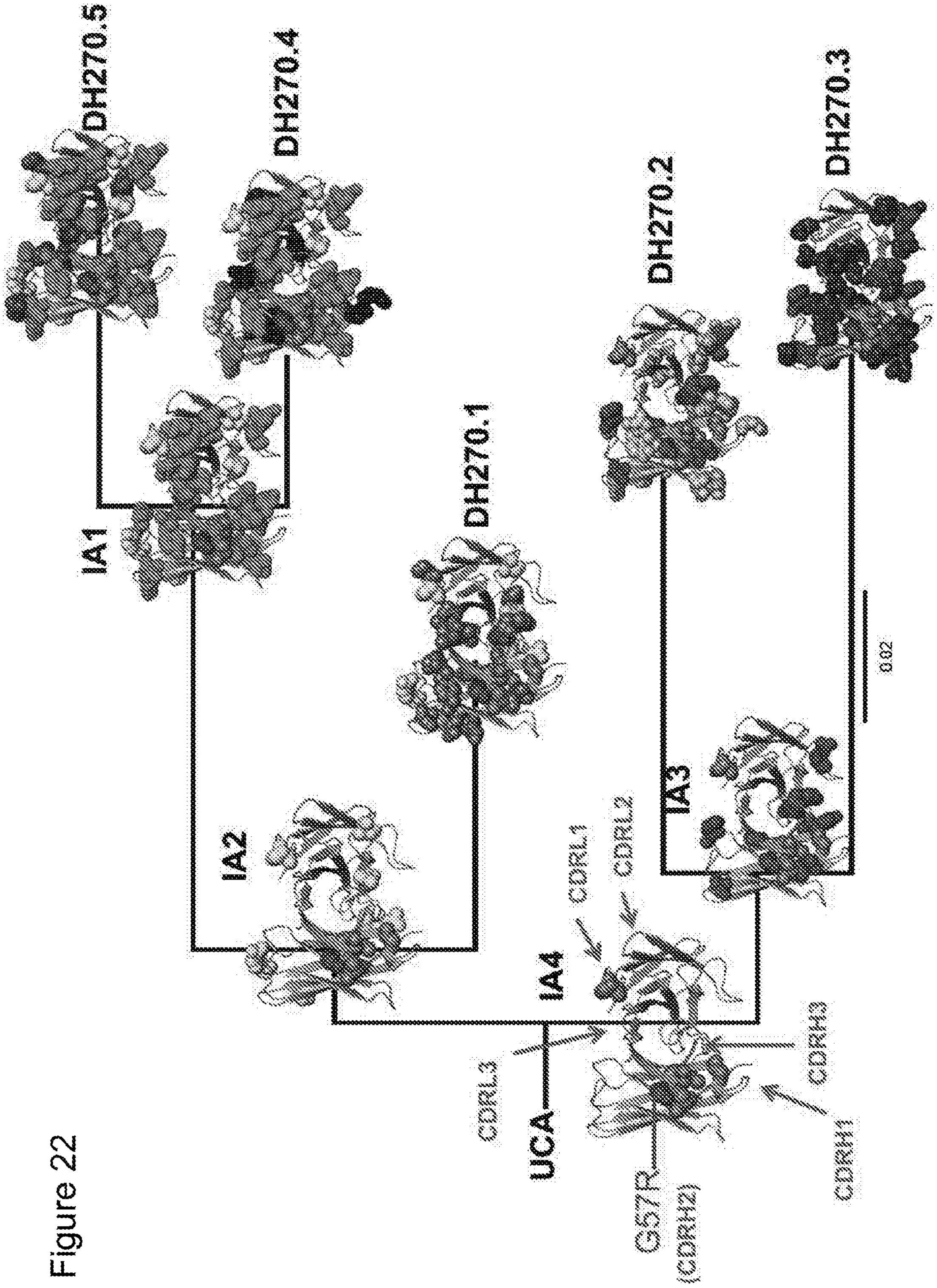

FIG. 22. Accumulation of mutation in DH270 lineage antibodies. Mutations are highlighted as spheres on the Fv region of each antibody, where the CDR regions, labeled on the backbone of the UCA, face outward. The G57R mutation is shown in red; the other mutations incurred between the UCA and IA4 are shown in orange. Mutations between intermediates are colored as follows: between IA2 and IA4, yellow; between IA1 and IA2, green; between IA3 and IA4, magenta. Mutations between the late intermediates and DH270.1, DH270.2, DH270.3, DH270.4, and DH270.5 are in brown, light purple, dark purple, blue, and dark blue, respectively.

Figure 23A:
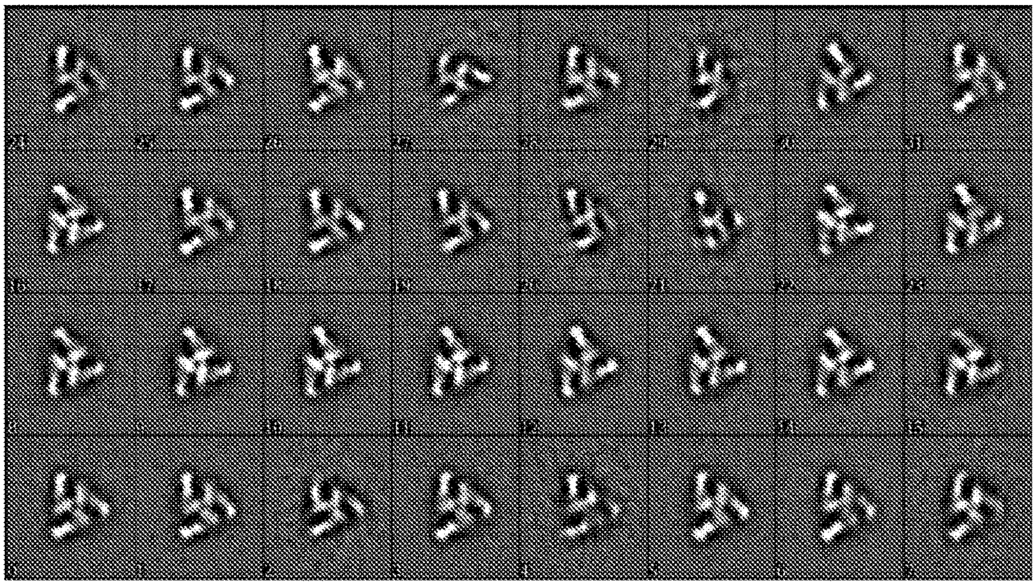
Figure 23B:
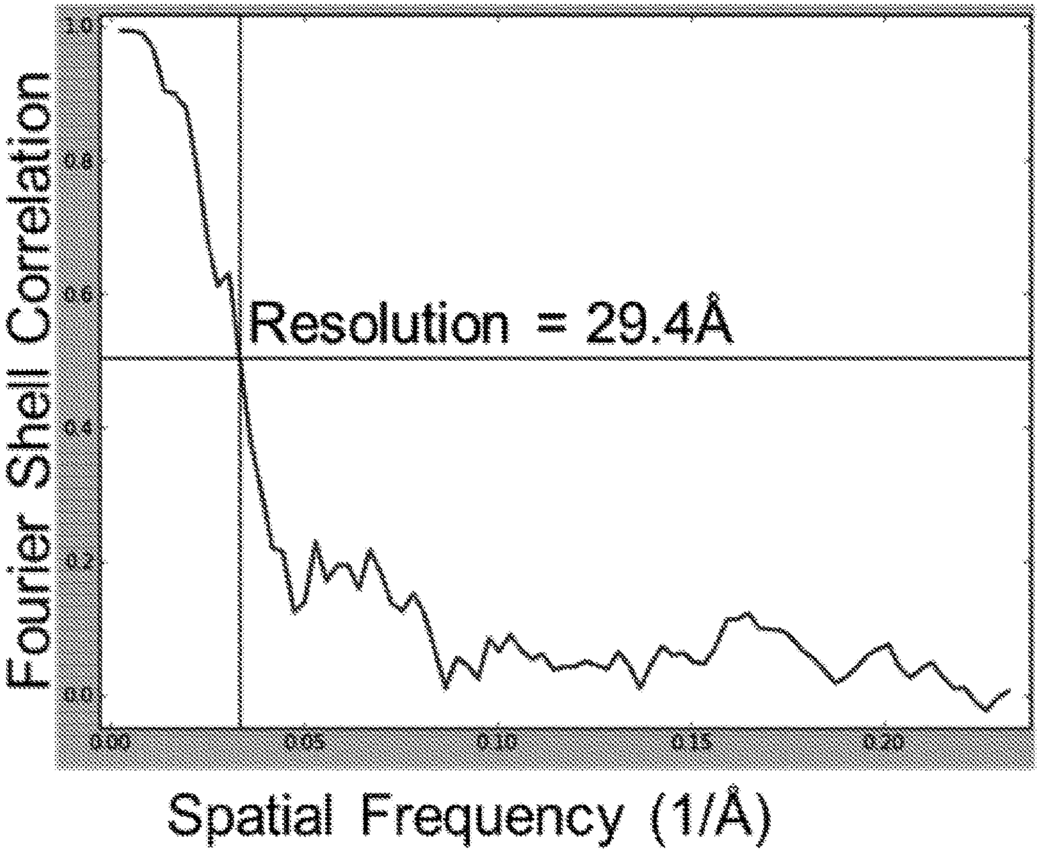

FIGS. 23A-B. Negative stain EM of DH270 Fab in complex with the 92BR SOSIP.664 trimer. (A) 2D class-averages of the complex. Fabs are indicated with a red arrow. (B) Fourier shell correlation curve for the complex along with the resolution determined using FSC=0.5.

Figure 24:
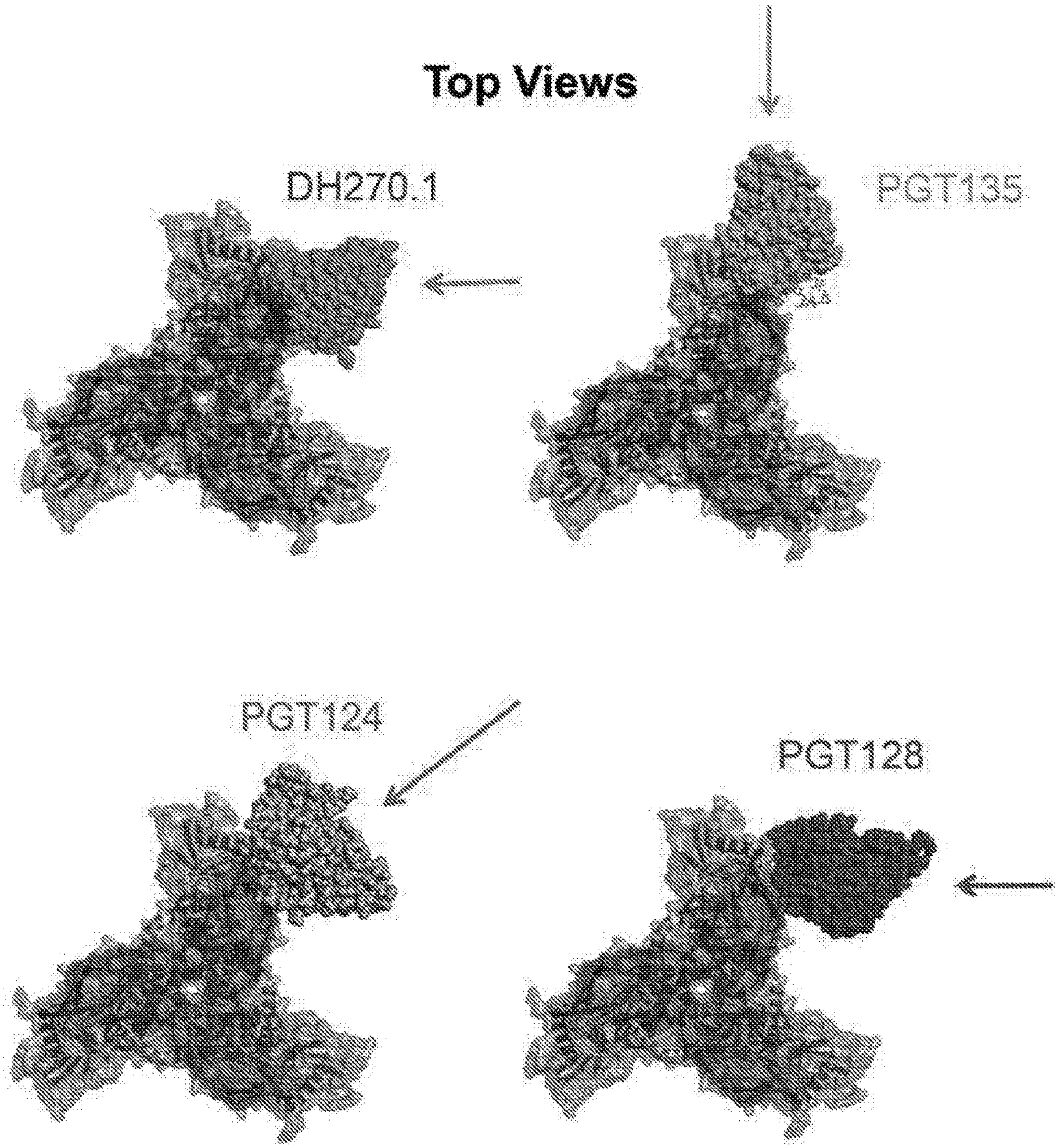
Figure 24:
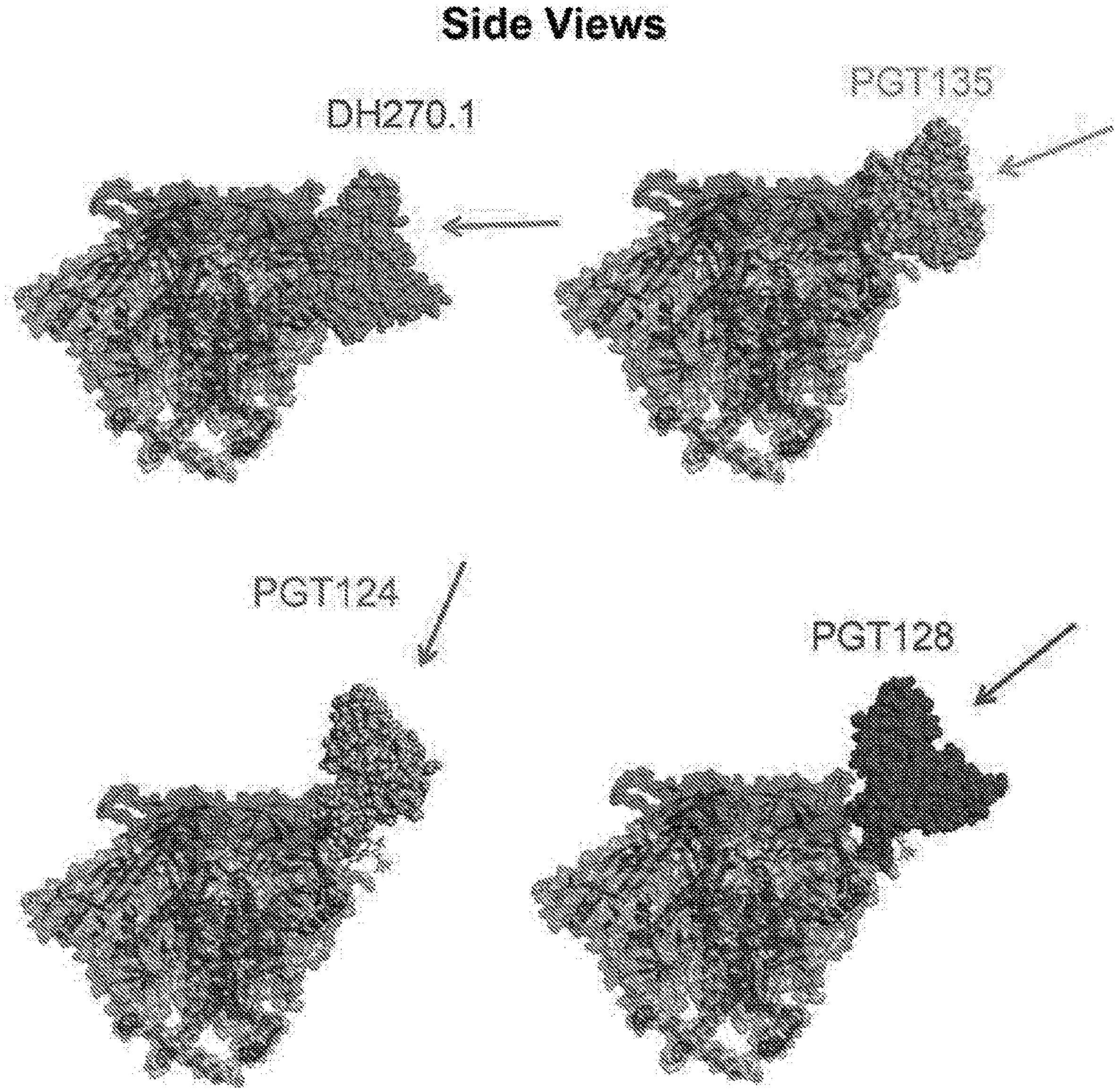

FIG. 24. DH270.1 and other N332 bnAbs bound to the 92BR SOSIP.664 trimer. Top and side views of the BG505 trimer (PDB ID: 5ACO) (28) (gray, with V1/V2 and V3 loops highlighted in red and blue, respectively) bound with DH270.1 (green), PGT135 (PDB ID: 4JM2) (22) (cyan), PGT124 (PDB ID: 4R2G) (27) (orange) and PGT128 (PDB ID: 3TYG) (17) (magenta) illustrate the different positions of the several Fabs on gp140. The arrows indicate the direction of the principal axis of each of the bnAb Fabs; the color of each arrow matches that of the corresponding bnAb.

Figures 25A, 25B:
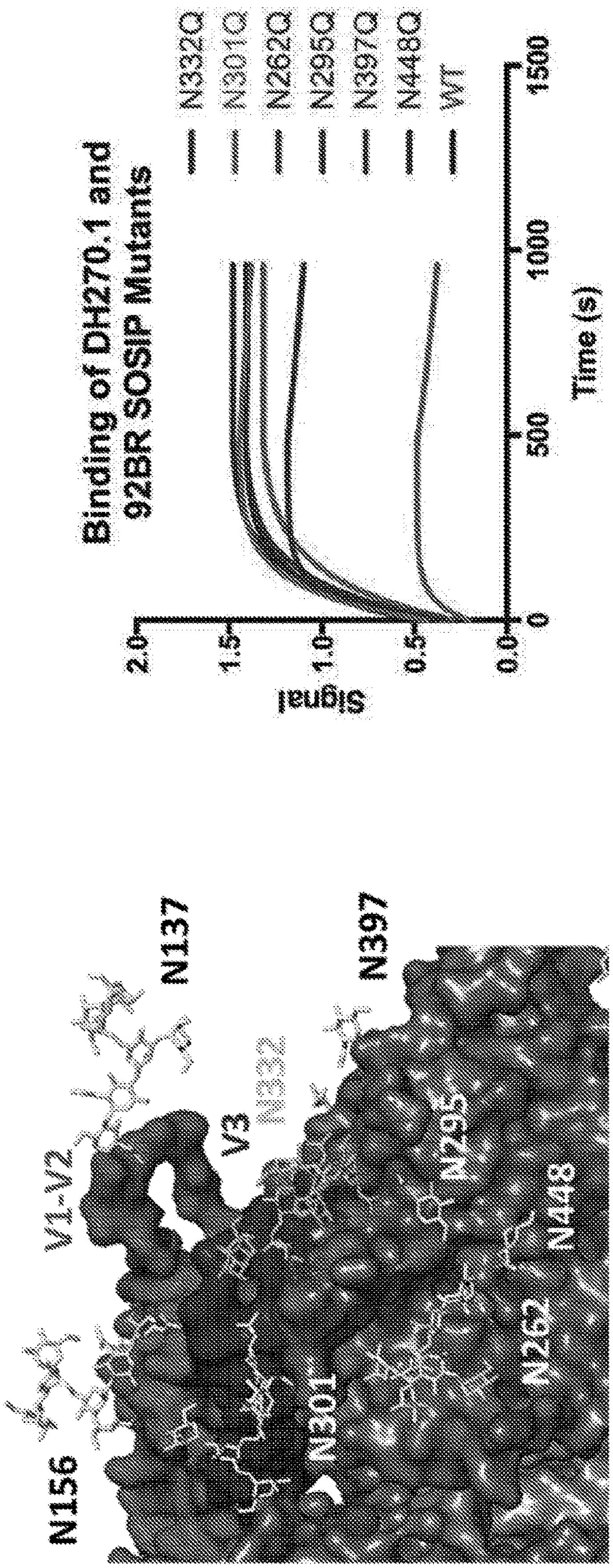

FIGS. 25A-B. DH270.1 binding kinetics to 92BR SOSIP.664 trimers with mutated PNG sites. (A) Glycans forming a "funnel" are shown on the surface of the trimer. V1-V2 and V3 loops are colored red and blue, respectively. (B) Association and dissociation curves, using biolayer interferometry, against different 92BR SOSIP.664 glycan mutants.

Figures 26A, 26B, 26C:
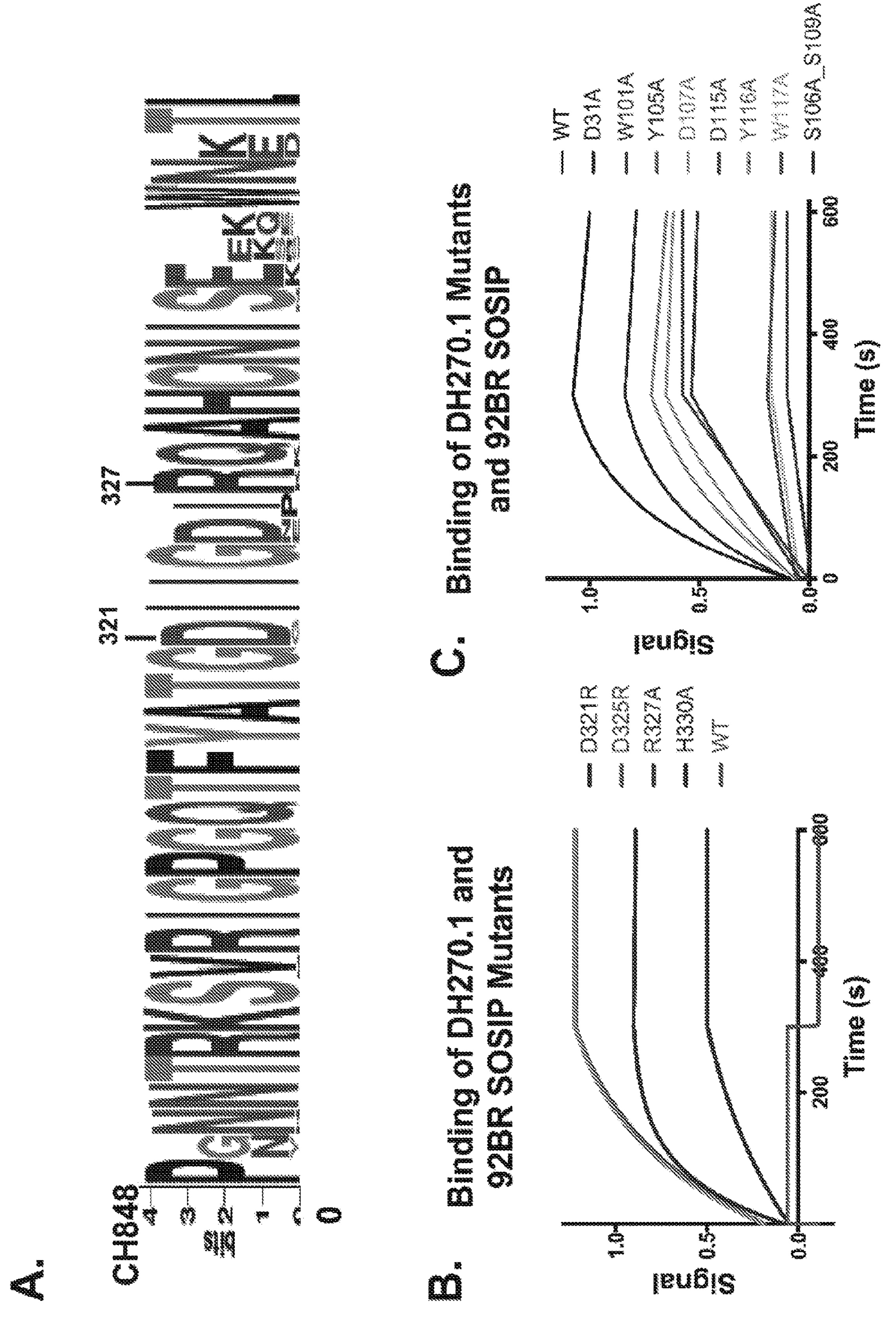

FIGS. 26A-C. DH270.1 binding kinetics to 92BR SOSIP.664 trimer with additional mutations. (A) Sequence Logo of the V3 region of CH848 autologous viruses are shown. (B) Binding kinetics, using biolayer interferometry, against different 92BR SOSIP.664 V3 loop region mutants. (C) DH270.1 heavy chain mutants and 92BR SOSIP.664. Biolayer interferometry association and dissociation curves for the indicated Fab mutants for binding to 92BR SOSIP.664 (600 nM curves are shown) Not shown are curves for DH270.1 heavy chain mutants K32A, R72A, D73A, S25D, S54D, S60D and double mutant S75/77A for which there was little or no reduction in affinity.

Figure 27A:
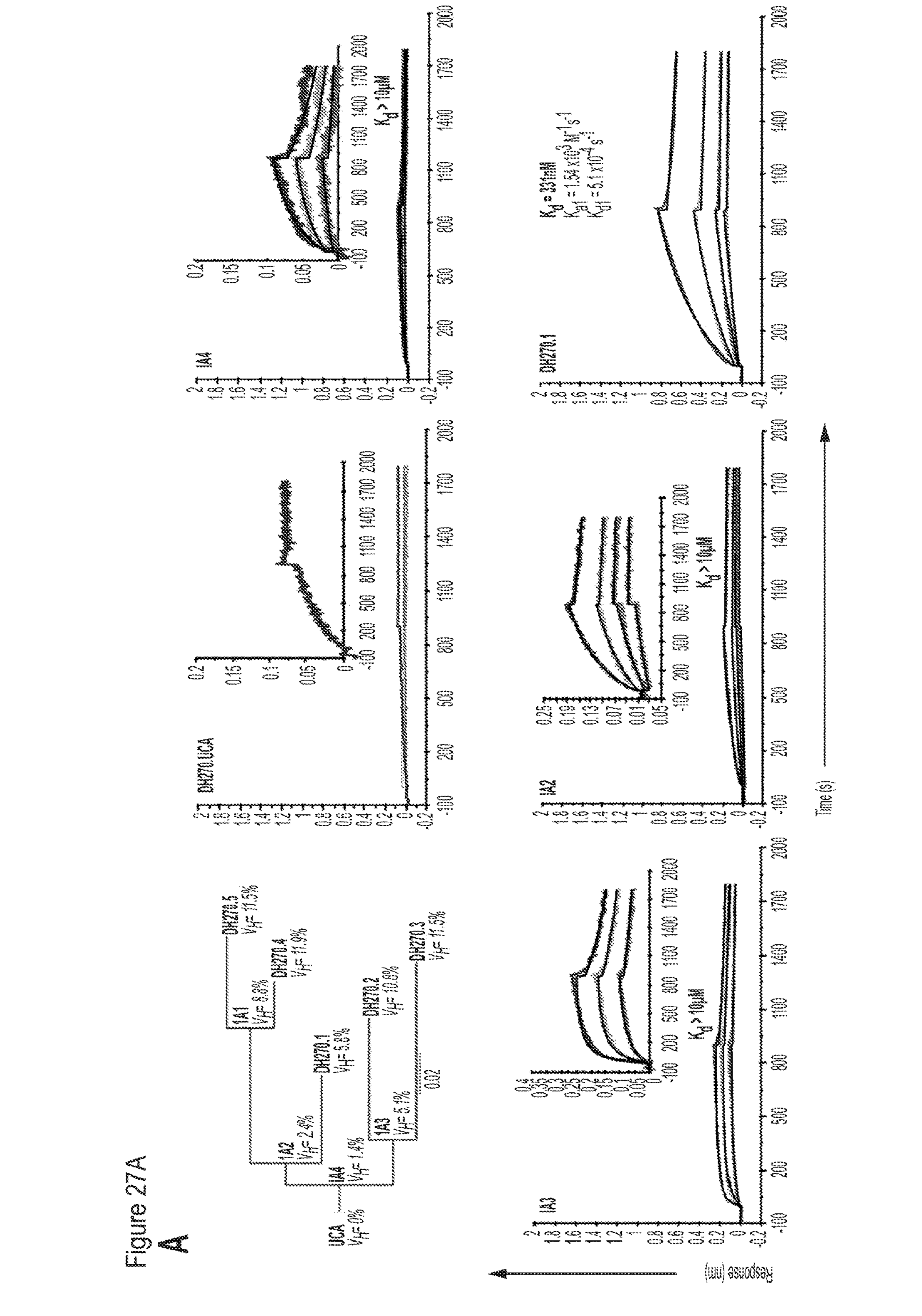
Figure 27A:
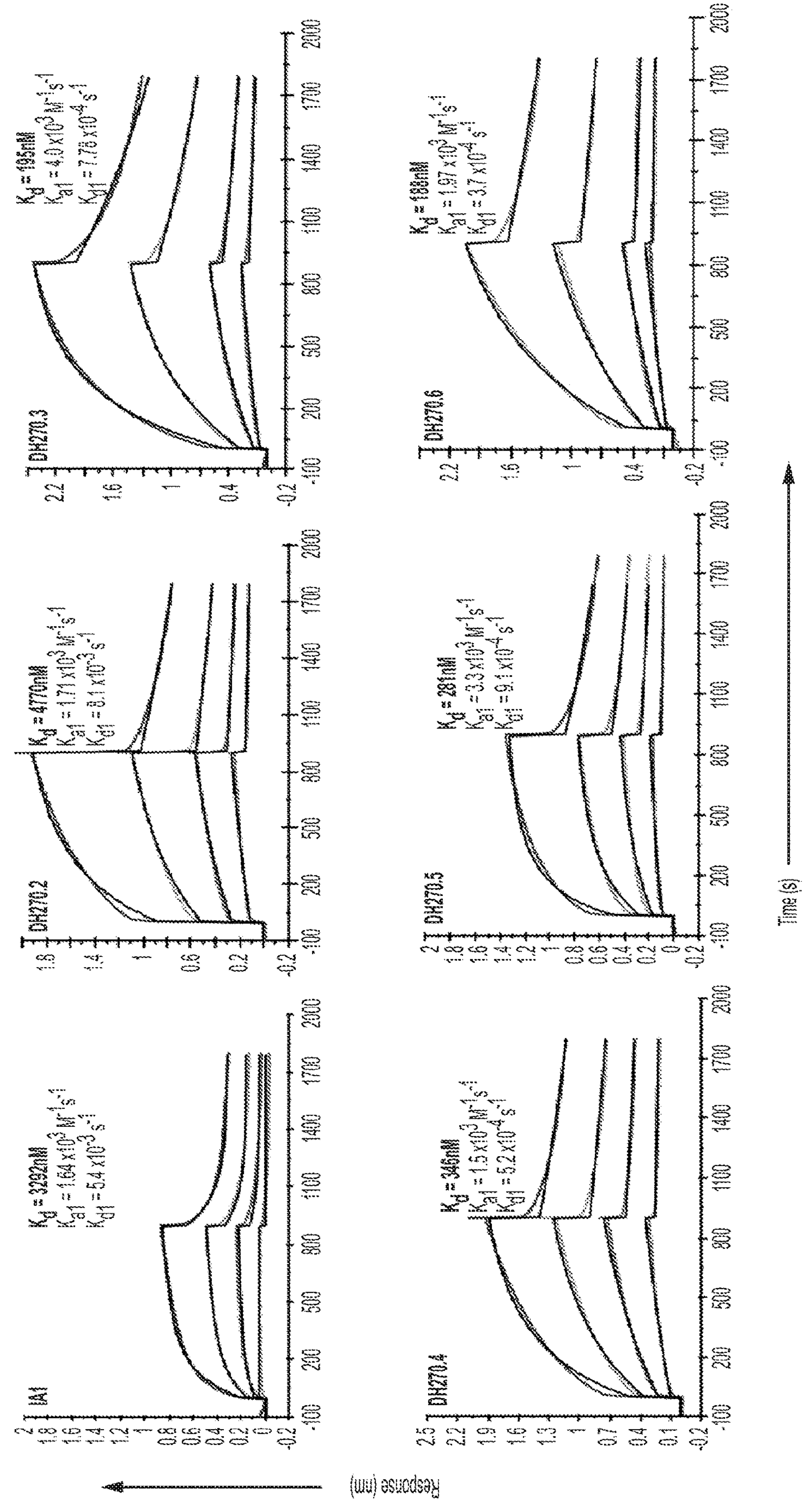
Figure 27B:
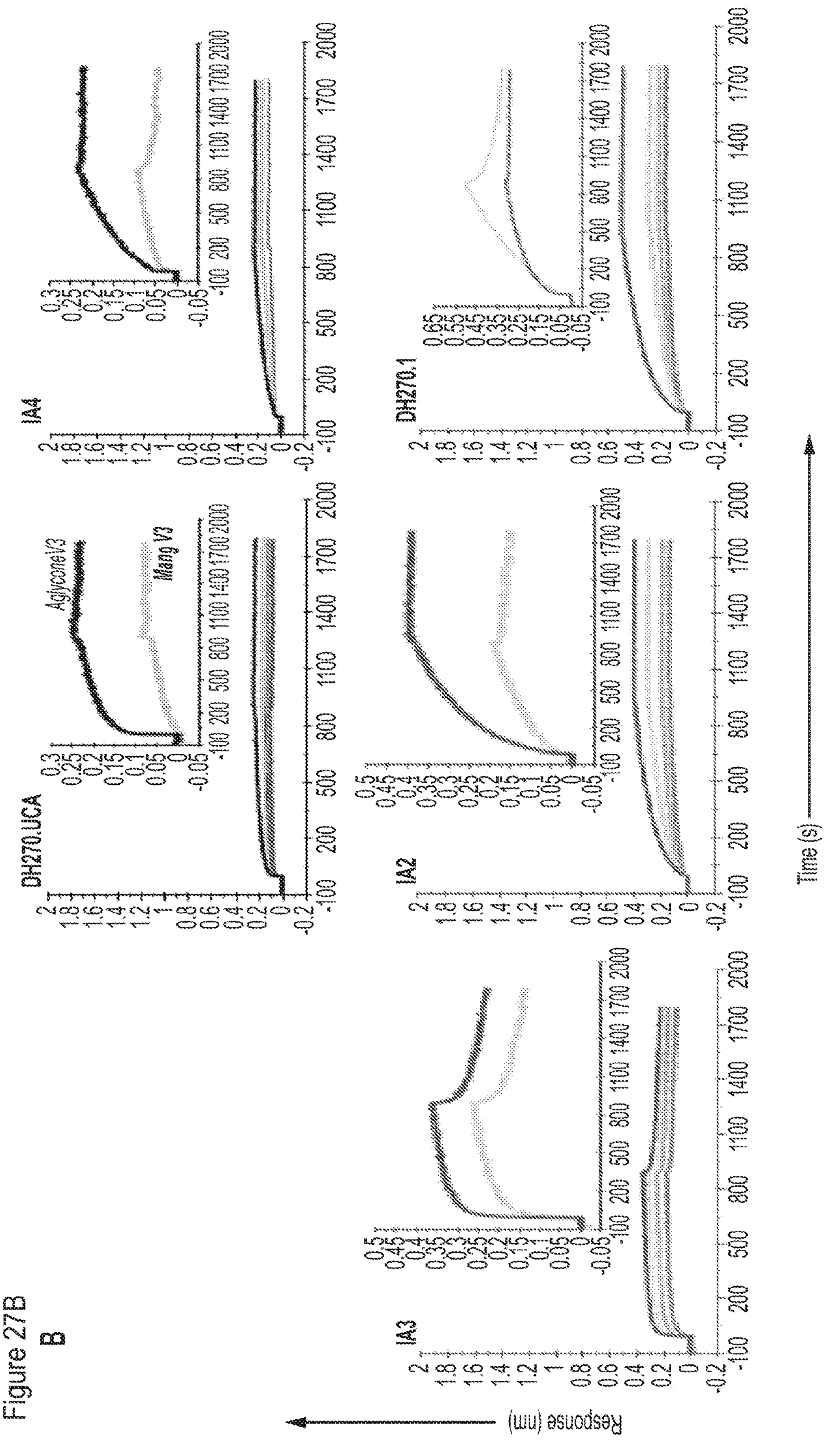
Figure 27B:
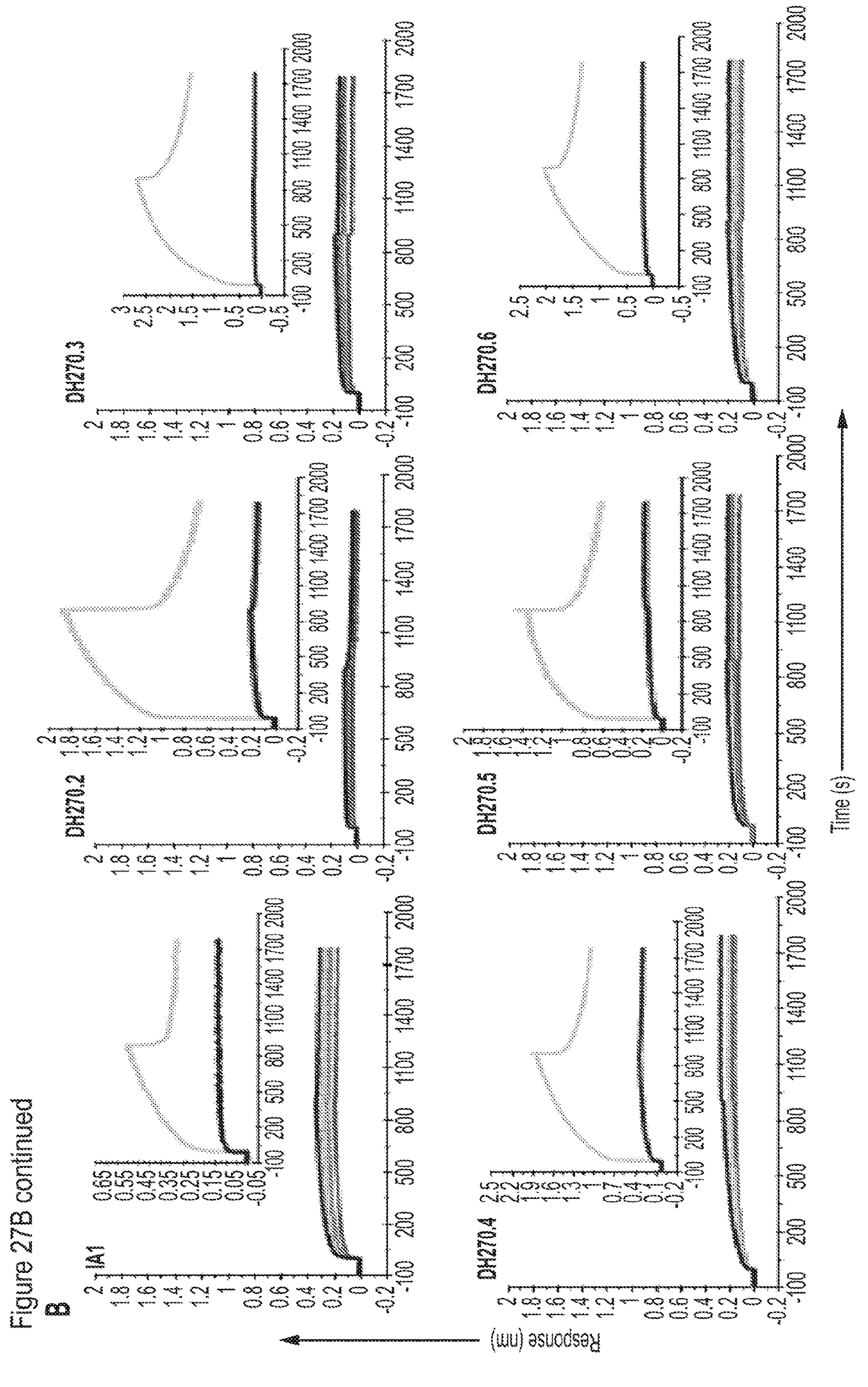

FIGS. 27A-B. $Man_9$-V3 glycopeptide binding of DH270 lineage antibodies. DH270 lineage tree (A, top left) is shown with VH mutations of intermediates and mature antibodies. DH270.6 mAb, which clusters close to DH270.4 and DH270.5, is not shown in the phylogenetic tree. Binding of Man9-V3 glycopeptide and its aglycone form to DH270 lineage antibodies was measured by BLI assay using either biotinylated Man9-V3 (A) or biotinylated aglycone V3 (B) as described in Methods. DH270 lineage antibodies were each used at concentrations of 5, 10, 25, 50, 100, 150 μg/mL. Insets in (A) for UCA (150 μg/mL), IA4 (100, 50, 25 μg/mL), IA3 and IA2 (100, 50, 25, 10 μg/mL) show rescaled binding curves following subtraction of non-specific signal on a control antibody (Palivizumab). Rate (ka, kd) and dissociation constants (Kd) were measured for intermediate IA1 and mature mAbs with glycan-dependent binding to Man9-V3. Kinetics analyses were performed by global curve fitting using bivalent avidity model and as described in methods ("Affinity measurements" section). Inset in (B) show overlay of binding of each mAbs to Man9-V3 (blue) and aglycone V3 (red) at the highest concentration used in each of the dose titrations.

FIG. 28. Example of an immunization regimen derived from studies of virus-bnAb coevolution in CH848. An immunization strategy composed of the following steps: first, prime with an immunogen that binds the UCA and the boost with immunogens with the following characteristics: i. engagement of DH270.IA4-like antibodies and selection for the G57R mutation; ii. Selection of antibodies that favor recognition of trimeric Env and expand the variation in the autologous signature residue to potentially expand recognition of diversity in population; iii. Exposing maturing antibodies to viruses with longer loops, even though these viruses are not bound or neutralized as well as viruses with shorter V1 loops, as this is the main constrain on antibody heterologous population neutralization breadth.

FIG. 29. N332-dependent CH848 plasma neutralization. Fold difference in CH848 plasma neutralization IC50 of selected wild-type and N332 mutant HIV-1 strains FIGS. 30A-C. NGS longitudinal sampling of $V_HDJ_H$ rearrangements assigned to the DH270, DH272 and DH475 lineages from memory B cell mRNA.

FIG. 31. CH848 plasma neutralization breadth over time.

FIG. 32. Data collection and refinement statistics.

FIG. 33. DH270 lineage heterologous neutralization (207-virus panel). Figure discloses SEQ ID NOS 115-322, respectively, in order of appearance.

FIGS. 34-35. Autologous binding and neutralization of DH270 lineage, DH272 and DH475 and heterologous neutralization on 24 virus panel.

FIG. 36. Virus signatures.

Figure 37B:
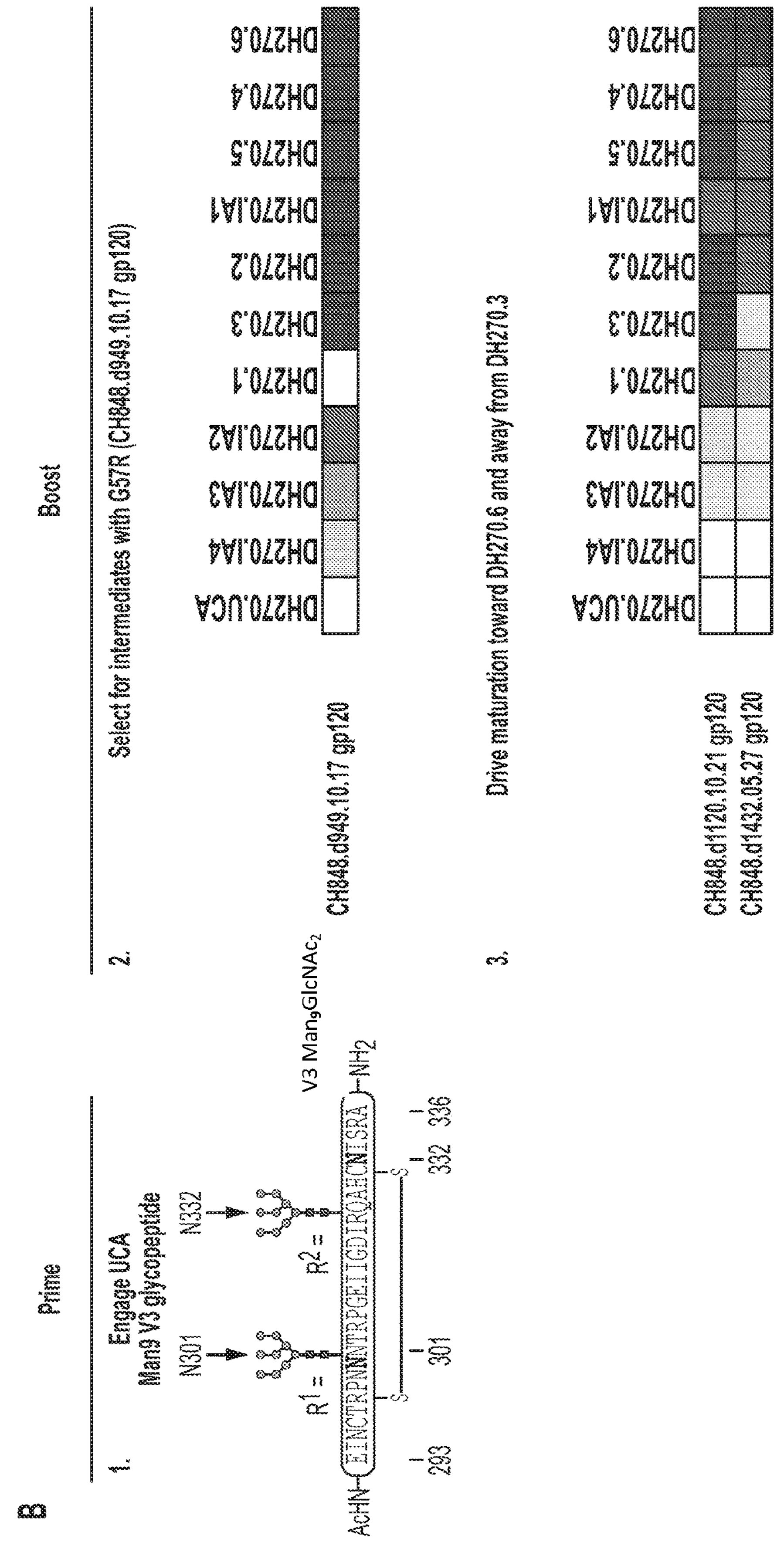
Figure 37C:
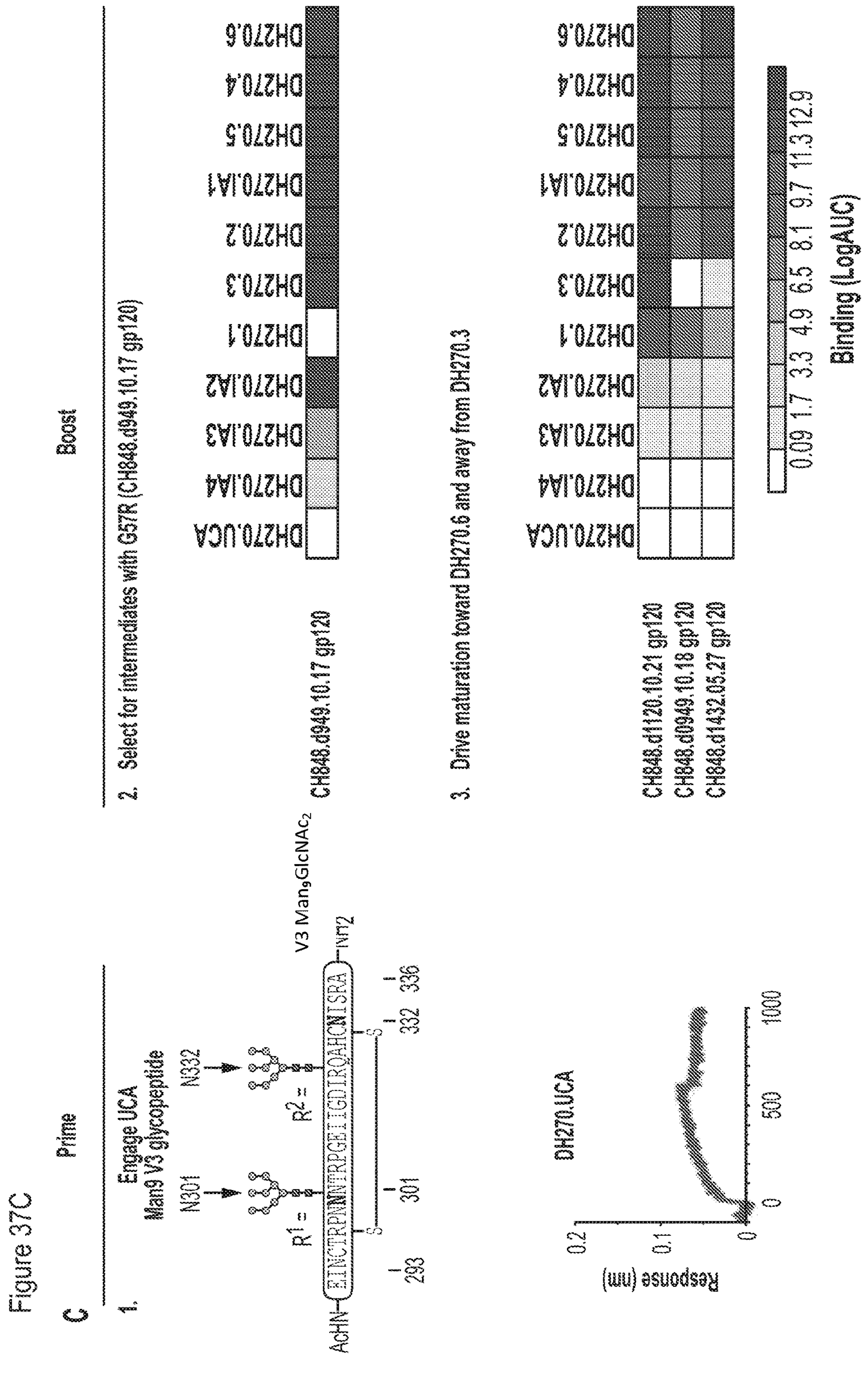

FIGS. 37A-D. FIGS. 37A-37D show non-limiting embodiments of selection of immunogens to induce V3 antibodies. The figures show binding of gp120 envelopes listed (and/or neutralization) in the figure to various antibodies from the V3 glycan antibody lineage DH270. FIG. 37A: Prime with Man9 V3 glycopeptide or aglycone. Boost (i)—expected to activate IA4, select for rare mutation; Boost (ii)—select for antibodies that favor the trimer with, expand the variation in the autologous signature residue to potentially expand recognition of diversity in the population. Boost (ii) in FIG. 37A is optional. Boost (iii)—expected to expose the virus to longer loops, even though these viruses don't bind or neutralize as well as viruses with shooter loops, as this is the main constrain on heterologous population breadth and that is what we need. One embodiment of a V3 peptide is SEQ ID NO: 1. FIG. 37D shows one non-limiting embodiment of a selection of immunogens. These immunogens in any suitable form are expected to be used as boost(s) in the induction of V3 glycan antibodies such as but not limited to antibodies with the specificity of DH270 lineage antibodies. For priming: Man9 V3 glycopeptide or aglycone engages UCA and allows G57R to occur (i.e. UCA to IA4). Boost with CH848.d949.10.17 (V1 loop length=17) selects IA4 with G57R. (1) CH848.d794.05.41 (V1 loop length=11) engages IA3 and IA2-like antibodies and further increase chances to induce DH270.1-like antibodies. The matching virus of this envelope is still neutralized by IA3 and IA2. (optional step). (2) CH848.d358.80.06 (V1 loop length=24) engages DH270.1-like antibodies and bring them to DH270.4, 0.5 and 0.6-like gradually increasing exposure to longer V1 loops. The matching virus is neutralized by DH270.1 and more mature bnAbs antibodies. At this point, we may or may not already have induced bnAbs, according to the importance of exposing antibodies to longer V1 loops. (3) CH848.d526.25.09 (V1 loop length=27) exposes bnAbs DH270.4-DH270.6 to longer V1 loop. Binding to DH270.3 is disfavored. (4) CH848.d0526.25.02 (V1 loop length=34) further exposes to even longer V1 loop. There is a cost in neutralization IC50, yet if increasing V1 length is correlated with breadth, then it should bring breadth. FIGS. 37B and 37C disclose SEQ ID NO: 1.

Figure 38A:
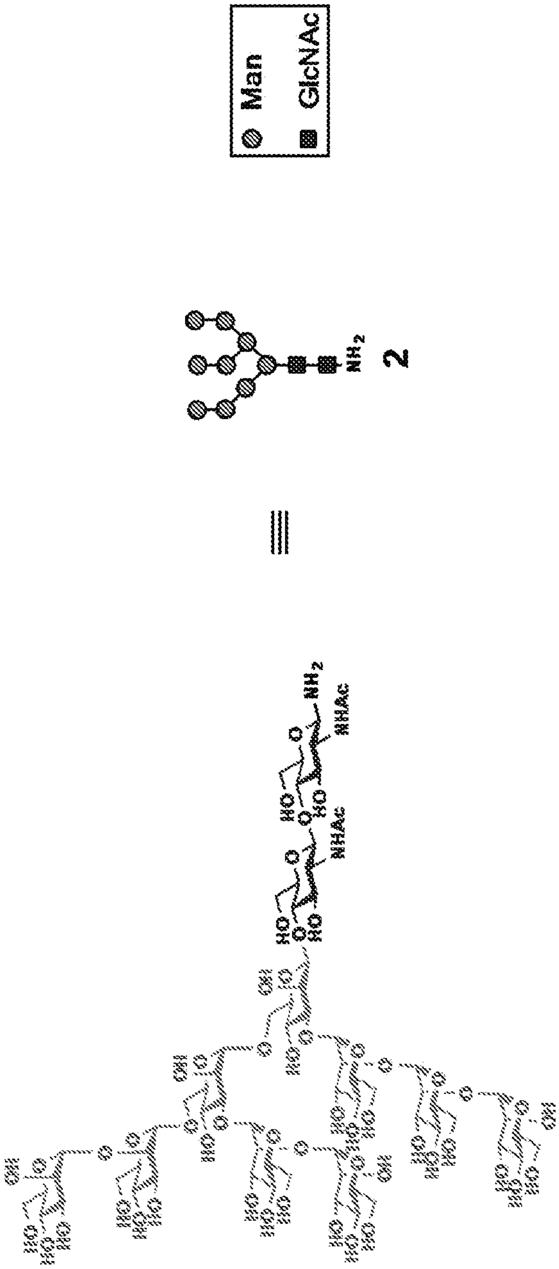
Figure 38A:
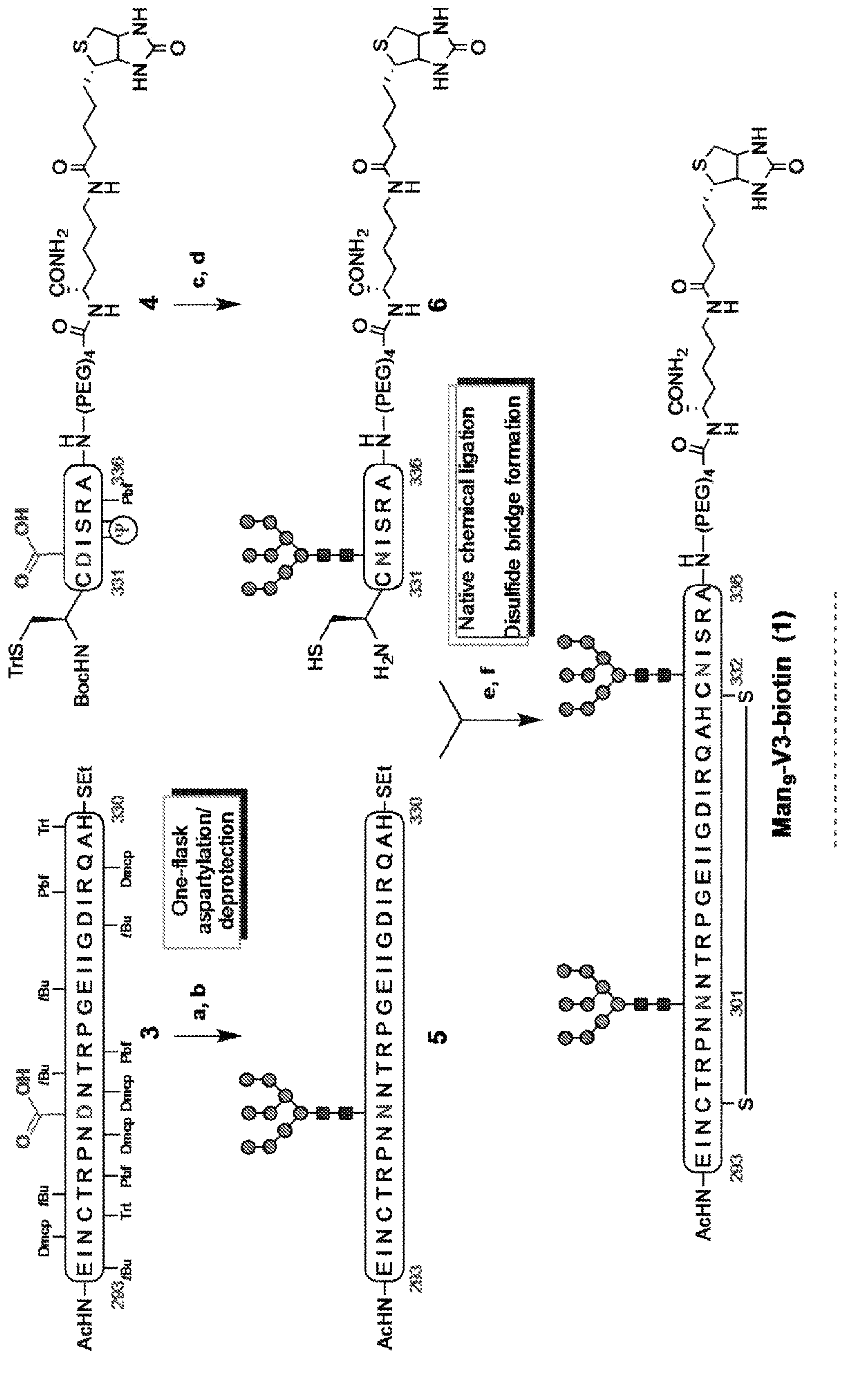
Figure 38A:
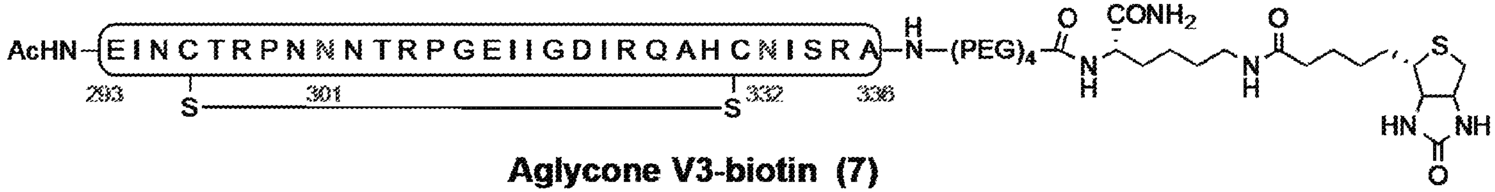
Figure 38B:
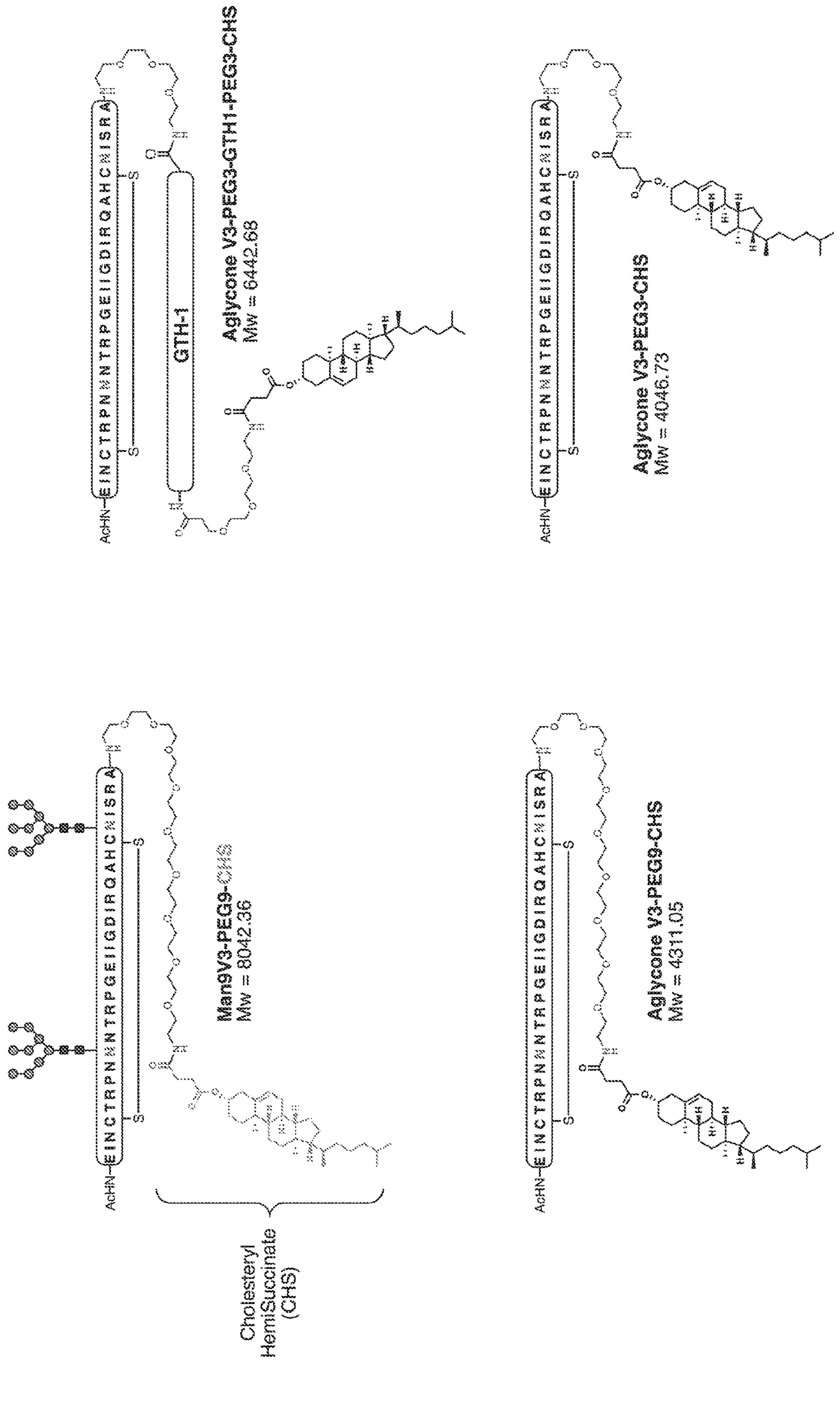
Figures 38C, 38D:
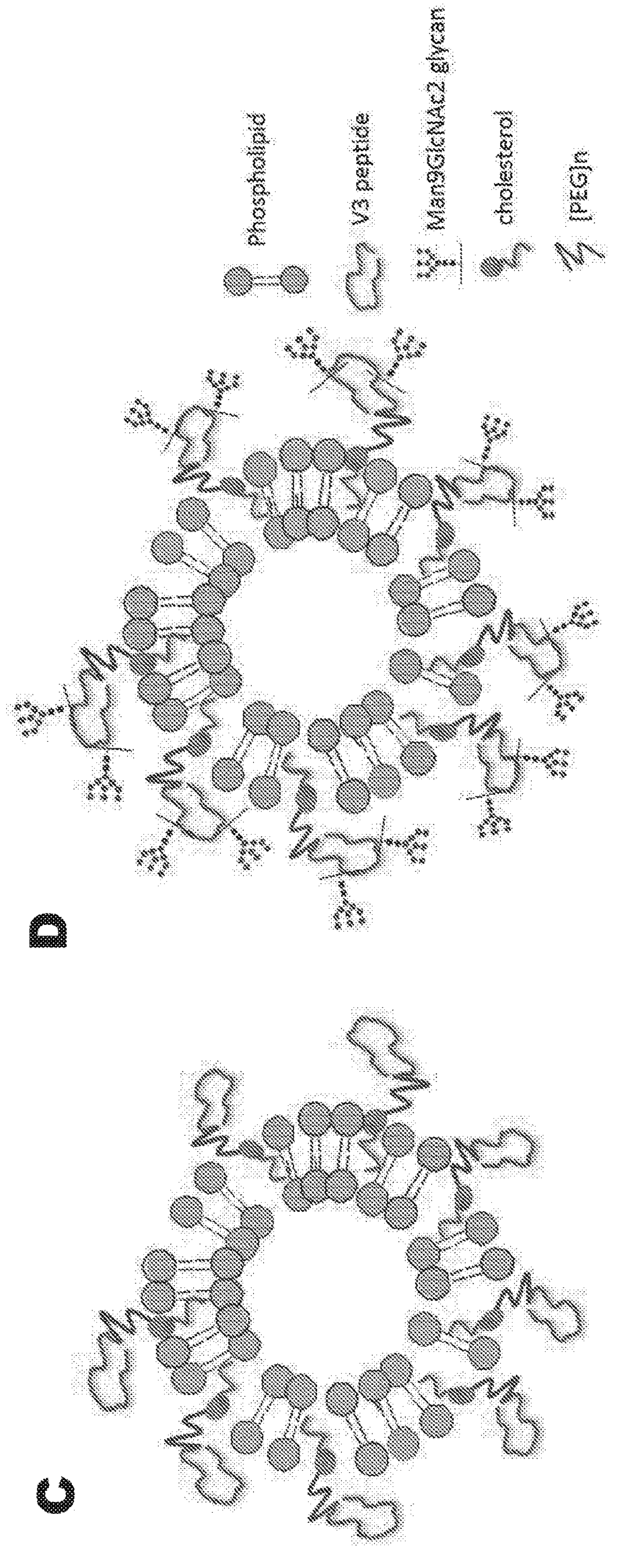
Figure 38E:
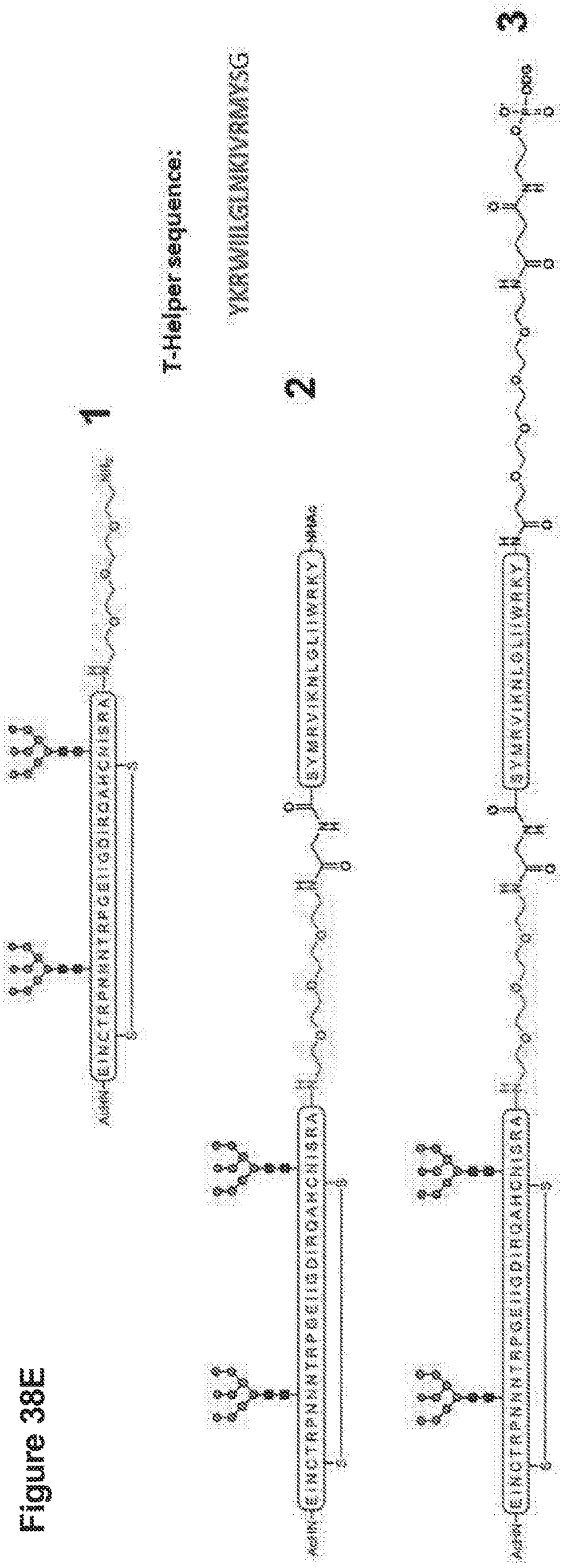

FIGS. 38A-E. FIG. 38A shows synthesis of $Man_9$ derivatized V3 glycopeptide. Chemical synthesis of oligomannose ($Man_9$) derivatized V3 glycopeptide. (A) Chemical structure of $Man_9GlcNAc_2$—$NH_2$. (B) Synthesis of $Man_9$-V3-biotin Glycopeptide 1-reagents and conditions: (a) $Man_9GlcNAc_2$—$NH_2$ (2), PyAOP, DIEA, DMSO; (b) Cocktail R=90:5:3:2 TFA/thioanisole/ethanedithiol/anisole, 32% (2 steps); (c) $Man_9GlcNAc_2$—$NH_2$ (2), PyAOP, DIEA, DMSO; (d) Cocktail R=90:5:3:2 TFA/thioanisole/ethanedithiol/anisole, 35% (2 steps); (e) 6 M Gnd-HCl, 200 mM Na2HPO4, 200 mM MPAA, 20 mM TCEP-HCl, pH 7.2; (e) 0.1 M Gnd-HCl, pH 7, 40% (2 steps). (C) Chemical structure of Aglycone V3-biotin. PyAOP=(7-Azabenzotriazol-1-yloxy)tripyrrolidinophosphonium hexafluorophosphate; DIEA=N,N-Diisopropylethylamine; DMSO=dimethyl sulfoxide; TFA=trifluoroacetic acid; Gnd-HCl=guanidine hydrochloride; MPAA=4-Mercaptophenylacetic Acid; TCEP-HCl=tris(2-carboxyethyl)phosphine hydrochloride. The aglycone V3 peptide has SEQ ID NO: 1. FIG. 38A discloses SEQ ID NOS 514-517, 1, and 1, respectively, in order of appearance. FIG. 38B discloses SEQ ID NOS 1, 1, 1, and 1, respectively, in order of appearance. FIG. 38E discloses SEQ ID NOS 1, 518, 1, 519, 1, and 519, respectively, in order of appearance.

FIG. 38B shows Synthetic lipid based V3 peptides for multivalent lipid nanoparticle constructs. Schematic of lipid nanoparticles with multimers of synthetic aglycone V3 (2C) and Man9V3 glycopeptide (D). In FIGS. 38C and 38D both Aglycone V3 and Man9V3 peptides were synthesized with a cholesterol moiety attached via PEG linker as outlined in FIG. 38B. The length of PEG linker is variable and can be short with [PEG]3 or longer with [PEG]9 or more units. In addition to the cholesterol unit linked to the V3 peptides, the lipid composition of the lipid nanoparticle constructs include the following phospholipid combinations-POPC:POPE:DMPA:cholesterol-V3/POPC:POPG:cholesterol-V3/DMPC:DOPG:cholesterol-V3/POPC:sphingomyelin:cholesterol-V3, each with varying % molar of cholesterol-V3 peptide (5-28 molar %). The V3 peptide to lipid ratio will be used to provide 50-200 mer V3 peptide units per 100 nm lipid nanoparticle. The multimeric V3 peptide lipid nanoparticles will be produced by methods previously described (Alam et al., 2007; 2009; Dennison et al., 2009, 2011. FIG. 38E shows synthetic V3 peptides for multivalent lipid nanoparticle constructs with $T_h$ peptide. The schematics shown in 2 and 3 both include the $T_h$ peptide GTH1 of the sequence shown above and will be covalently attached to the V3 aglycone or Man9 V3 glycopeptide (as shown in 2 and 3) via a [PEG]n linker of varying units. Other $T_h$ peptide sequence can be substituted and synthesized as in constructs 2 and 3. The amphipathic GTH1 sequence is also utilized for anchoring to lipid nanoparticles (Alam et al., 2007). The lipid compositions, and peptide:lipid molar ratios used will be as described in FIGS. 38C and 38D.

FIGS. 39A-B. FIG. 39A shows amino acids sequences of CH848.0949.10.17 in various forms (SEQ ID NOS 323-328 of Sequence Listing which has been submitted electronically in ASCII format and is hereby incorporated by reference in its entirety and forms part of the specification). Various other forms can readily be obtained from the gp160 amino acid sequence. A skilled artisan appreciates that recombinantly produced envelope of any form do not include the signal peptide. The endogenous signal peptide of CH0848.3.D0949.10.17 gp160 is provided in the figure. A heterologous signal peptide of CH0848.3.D0949.10.17 chim.6R.DS.SOSIP.664 is provided in the figure. FIG. 39B shows one embodiment of nucleic acid sequences of the designs in FIG. 39A (SEQ ID NOS 329-334 of Sequence Listing which has been submitted electronically in ASCII format and is hereby incorporated by reference in its entirety and forms part of the specification).

Figure 40C:
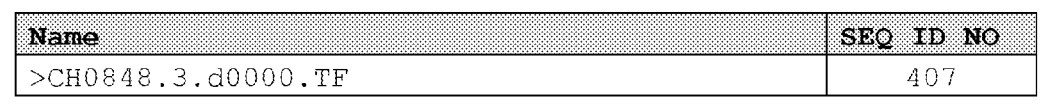

FIGS. 40A-C. FIG. 40A shows amino acid sequences of various forms of CH848 envelopes CH848.0836.10.31; CH848.0358.80.06; CH848.1432.5.41; CH848.0526.25.02. A skilled artisan appreciates that recombinantly produced envelope of any form do not include the signal peptide. Figure discloses SEQ ID NOS 335-370 of Sequence Listing which has been submitted electronically in ASCII format and is hereby incorporated by reference in its entirety and forms part of the specification. FIG. 40B shows one embodiment of nucleic acid sequences of the designs in FIG. 40A. FIG. 40B shows one embodiment of codon optimized nucleic acid sequences of the designs in FIG. 40A. FIG. 40B discloses SEQ ID NOS 371-406 of Sequence Listing which has been submitted electronically in ASCII format and is hereby incorporated by reference in its entirety and forms part of the specification.

FIG. 40C shows the amino acids sequence as gp160 of CH848 T/F envelope (SEQ ID NO: 407 of Sequence Listing which has been submitted electronically in ASCII format and is hereby incorporated by reference in its entirety and forms part of the specification). Using the description of the various envelopes, including but not limited to SOSIP designs, the CH848 T/F envelope can also be designed in any suitable form.

FIGS. 41A-C. FIG. 41A shows amino acid sequences of various forms of CH0848 envelopes (SEQ ID NOS 408-427 of Sequence Listing which has been submitted electronically in ASCII format and is hereby incorporated by reference in its entirety and forms part of the specification). A heterologous signal peptide of CH0848.3.D0949.10.17 chim.6R.DS.SOSIP.664V4.1 is provided in the figure (MPMGSLQPLATLYLLGMLVASVLA (SEQ ID NO: 42)). A skilled artisan appreciates that recombinantly produced envelope of any form do not include the signal peptide. FIG. 41B shows one embodiment of nucleic acid sequences of the designs in FIG. 41A (SEQ ID NOS 428-447 of Sequence Listing which has been submitted electronically in ASCII format and is hereby incorporated by reference in its entirety and forms part of the specification). FIG. 41C shows annotated amino acid sequence of a chimeric trimer design of CH848.3.D0949.10.17CHIM.6R.SOSIP.664V4.1. Figure discloses SEQ ID NOS 448-449, respectively, in order of appearance.

FIGS. 42 and 43 show the contacts, emphasizes position D325N, and that envelope CH848 1305.10.13 retains some binding and neutralization sensitivity. CH8481305.10.13 has a proline after the N, GDIR→GNPR (SEQ ID NOS 34 and 35, respectively). The proline at that position is really rare. Thus envelope CH0848.3.d1651.10.07, which has GNIR (SEQ ID NO: 36), and residual binding to DH270.4 and DH270.6 is a better vaccine choice.

FIGS. 44A-44D show amino acid and nucleic acid sequences of envelopes: >CH848 703010848.3.d0949.10.17_signature_opt_b gp160 (FIG. 44A) (SEQ ID NOS 450-455, respectively, in order of appearance), >CH848 703010848.3.d0949.10.17_signature_opt_filled_rare_holes_a gp160 (FIG. 44B) (SEQ ID NOS 456-461, respectively, in order of appearance), CH0848.3.d1651.10.07 (FIG. 44C) (SEQ ID NOS 462-467, respectively, in order of appearance), CH848 703010848.3.d0949.10.17_signature_opt_b_T250.4_V1V2 (FIG. 44D) (SEQ ID NOS 468-473, respectively, in order of appearance). Signal peptide, furin site and delta N deletion are indicated in FIG. 44C.

FIG. 45 shows amino acid sequences listed in Table 3 of Example 3A (SEQ ID NOS 474-502, respectively, in order of appearance).

FIG. 46 shows amino acid sequences of engineered V1 loop variants of CH848 3.d0949.10.17 envelope (Table 3 lines 23-25) (SEQ ID NOS 503-505, respectively, in order of appearance).

Figure 47B:
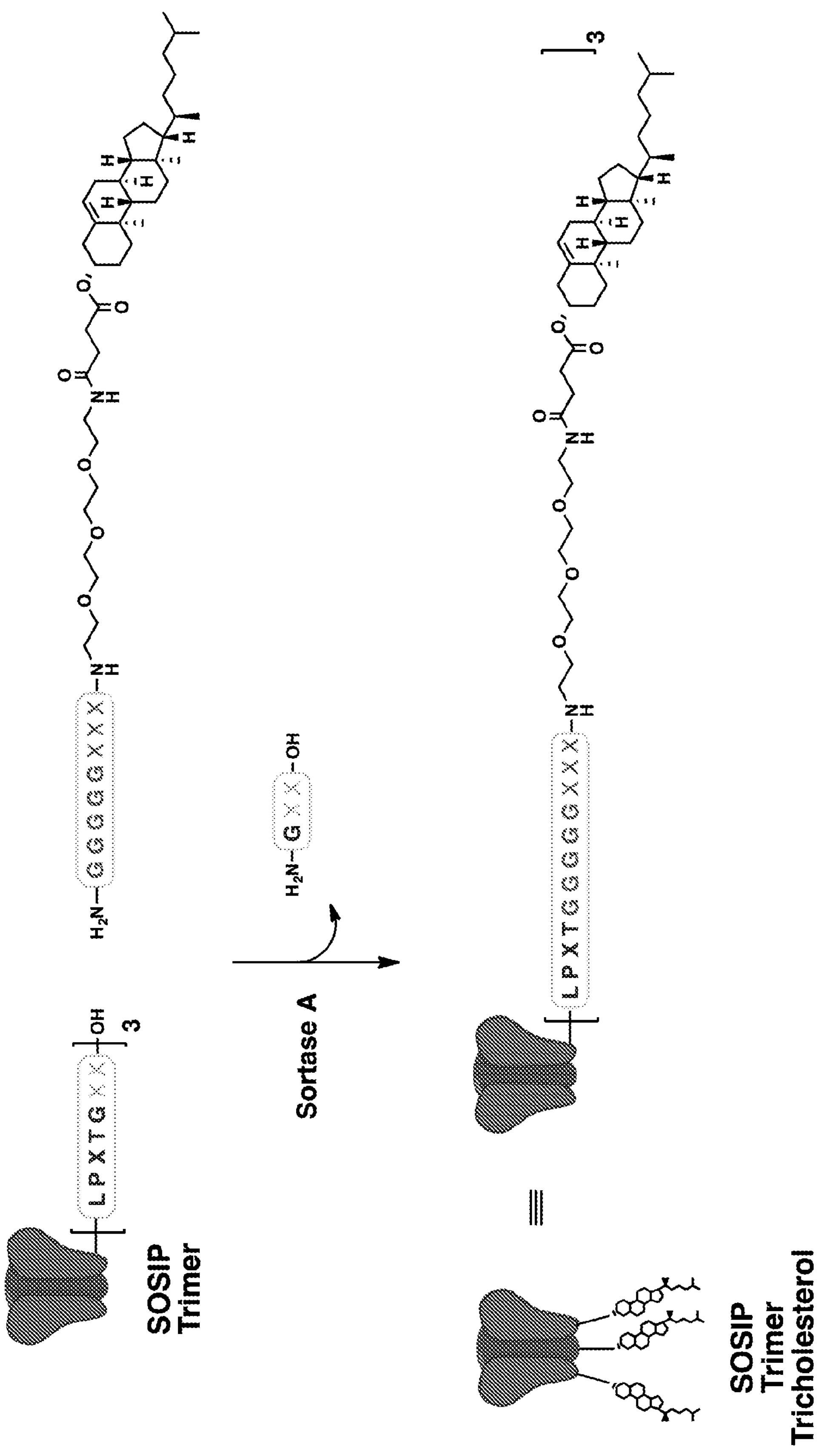
Figure 47C:
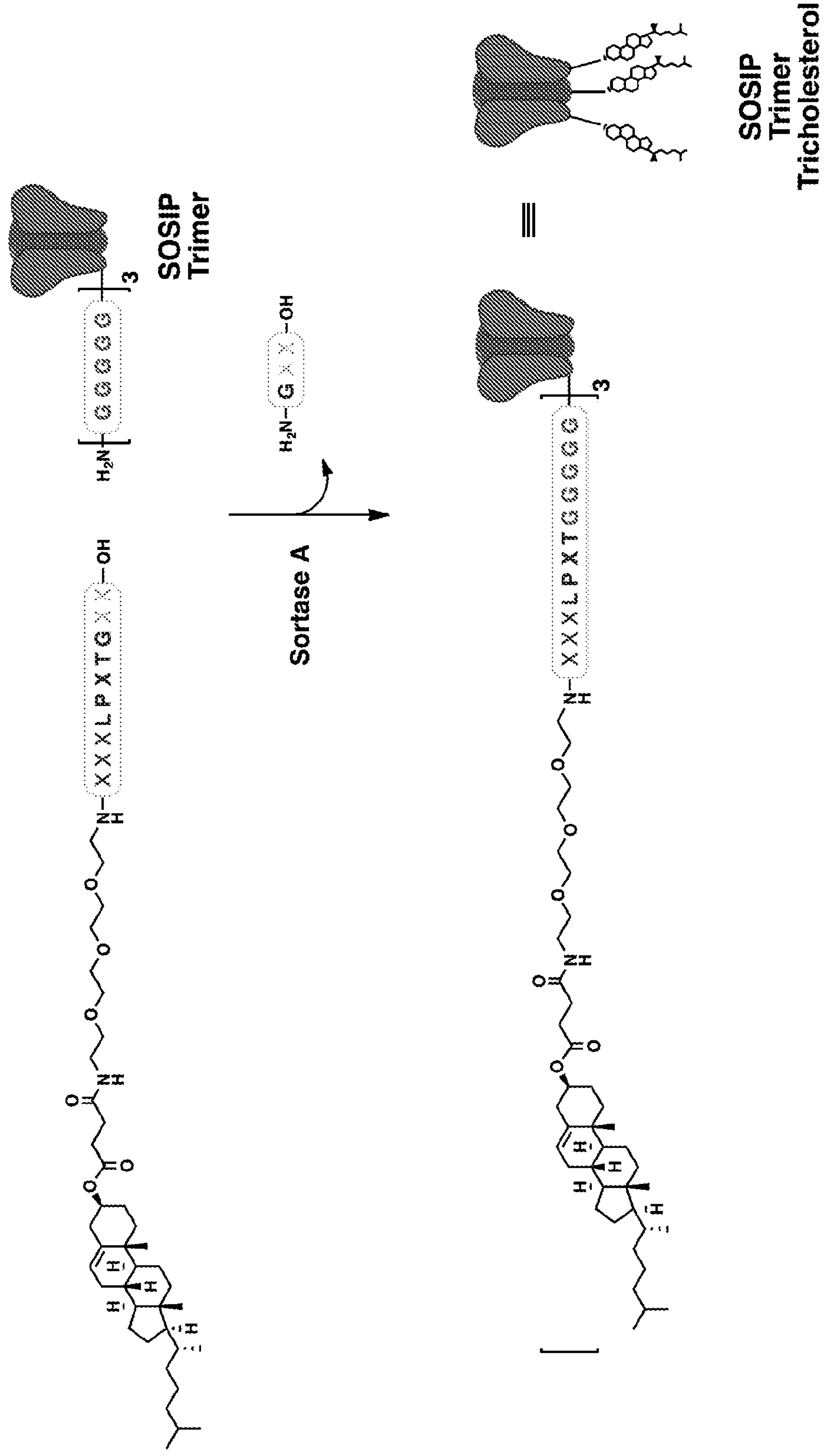

FIGS. 47A-47C shows SORTASE-C designs and sequences. FIG. 47A discloses SEQ ID NOS 506-509, respectively, in order of appearance. FIG. 47B discloses SEQ ID NOS 520-522, respectively, in order of appearance. FIG. 47C discloses SEQ ID NOS 523, 61, and 524, respectively, in order of appearance.

Figure 48A:
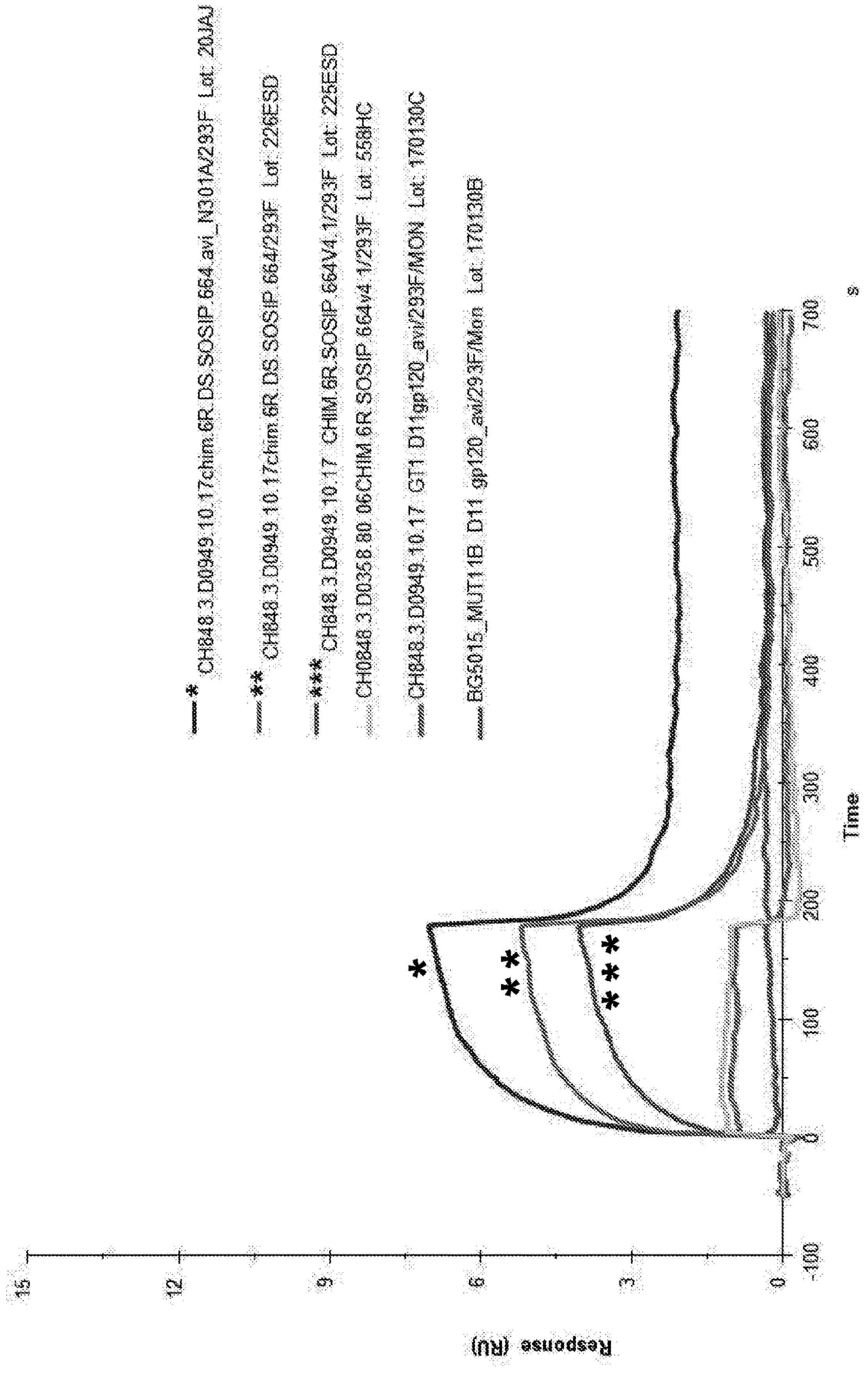
Figure 48B:
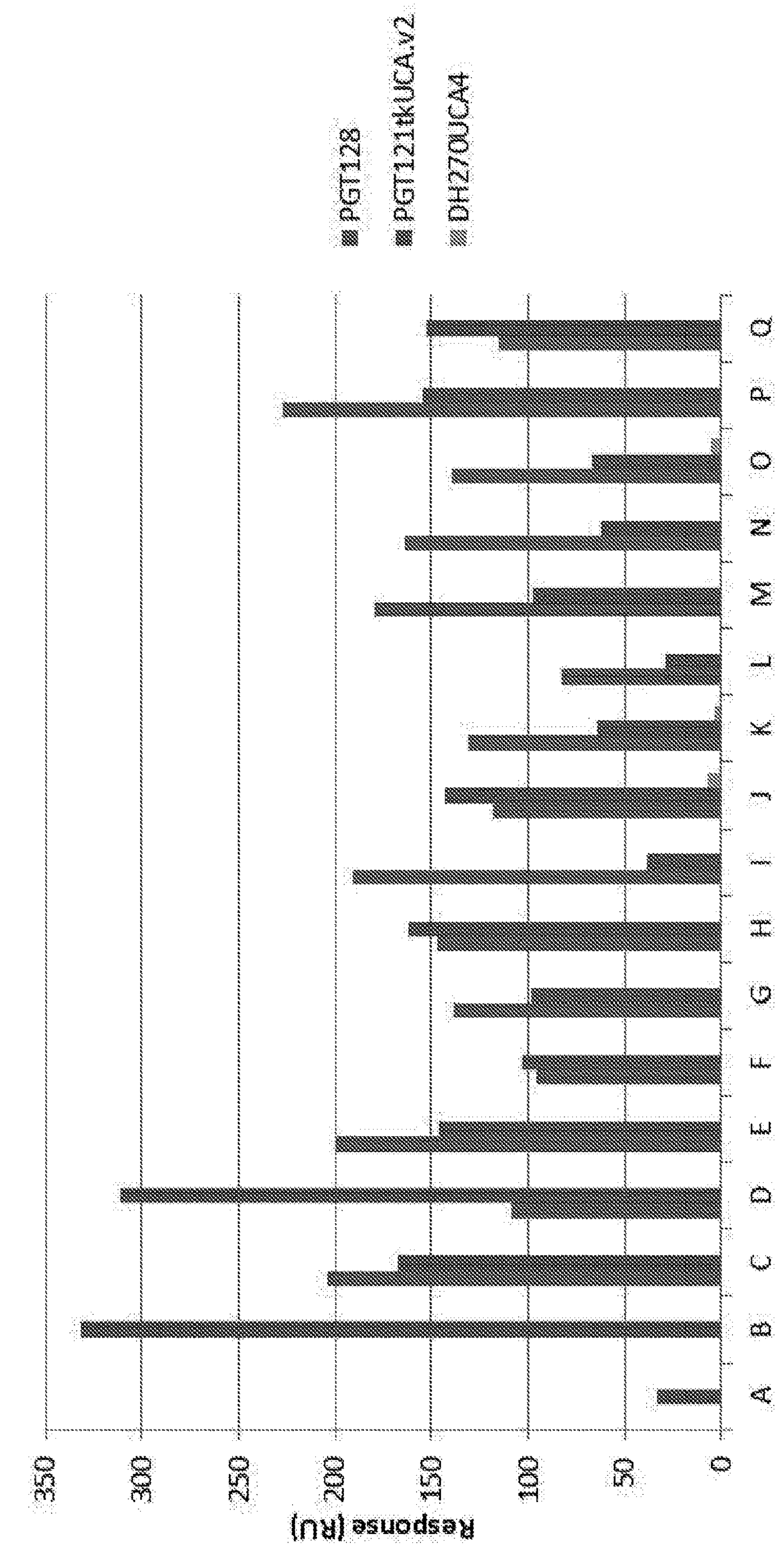

FIGS. 48A-48B show screening of various envelope constructs for binding to DH270UCA4 by SPR (SPR-S200). FIG. 48A shows DH270 UCA (unmutated common ancestor) binding to CH848 SOSIP gp140 trimers. CH848.3.D0949.10.17 SOSIP trimers (100 mg/mL) were injected over DH270_UCA captured on an anti-human Ig-Fc immobilized mAb sensor surface and binding monitored by SPR analysis on BIAcore S200 (GE Healthcare). DH270_UCA bound to SOSIP gp140 trimers but not to gp120 of CH848 Env. Among the CH848 trimers, more stable binding was observed with N301A mutation, indicating that the removal of the glycan at N301 facilitate the formation of more stable complex with DH270_UCA. FIG. 48B shows screening of various envelopes for binding to PGT121tkUCA_v2 and DH270UCA4_Protein Panel Screening by SPR (SPR-S200). Only J, K and O samples show binding to DH270UCA4. FIG. 48C lists the names of different envelopes tested in FIG. 48B. FIG. 48B listing of tested envelopes is as follows:

B.JRFL gp120core_mini_V3_v2/Kif/293F EndoH treated/Denatured 01.31.2017=“A”

B.JRFL gp120core_mini_V3_v2/Kif/293F EndoH treated/Native 01.31.2017=“B”

CH0848.3.D0949.10.17 gp140c/5 uM-Kif/293F Lot: 170131D=“C”

CH0848.3.D0836.10.31 gp140c/293F Lot: 170131B=“D”

CH0848.3.D0949.10.17 gp140c/25 uM-Kif/293F Lot: 170131A=“E”

CH0848.3.D0949.10.17 gp140c/293F Lot: 170131C=“F”

BG5015_MUT11B D11 gp120_avi/293F/Mon Lot: 170130B=“G”

CON-S gp140 CFI_avi V1_4Q/293F Lot: 160809C=“H”

JRFL mini V3 gp120 Core GNTI–/– Lot: 539HC=“I”

CH848.3.D0949.10.17chim.6R.DS. SOSIP.664.avi_N301A/293F Lot: 20JAJ=“J”

CH848.3.D0949.10.17 CHIM.6R.SOSIP.664V4.1/293F Lot: 225ESD=“K”

CH848.3.D0949.10.17 GT1 D11gp120_avi/293F/MON Lot: 170130C=“L”

BG505_MUT11B D11 gp120_avi/Kif/293F/Mon Lot: 170130A=“M”

B.JRFL gp120 Core_mini-V3_v2/Kif/293F/Mon Lot: 170130D=“N”

CH848.3.D0949.10.17chim.6R.DS.SOSIP.664/293F Lot: 226ESD=“0”

CH0848.3.D0358.80.06CHIM.6R.SOSIP.664v4.1/293F Lot: 558HC=“P”

B.JRFLgp140CF_aviV1 3Q/293F Lot: 160908B=“Q”

FIG. 49A shows an alignment of amino acid sequences of envelope CH848.3.D0949.10.17CHIM.6R.SOSIP.664V4.1 and CH848.3.D0949.10.17CHIM.6R.SOSIP.664V4.1 N133DN138T. Positions N133 and N138 could be mutated to any other suitable amino acid, such that glycosylation of the amino acid position is prevented. FIG. 49A discloses SEQ ID NOS 525-526, 525 and 527, respectively, in order of appearance.

FIG. 49B shows the sequence of HIV envelope CH0848.3.d1305.10.19gp160 (amino acid and nucleic acid sequence). FIG. 49B discloses SEQ ID NOS 528-529, respectively, in order of appearance.

FIGS. 50A-D shows sequences of various envelopes. FIGS. 50A-D disclose SEQ ID NOS 530-536, respectively, in order of appearance.

FIG. 51 shows sequences of various envelopes. FIG. 51 discloses SEQ ID NOS 537-542, 538, 543, 538 and 544, respectively, in order of appearance.

FIG. 52A shows sequence of CH848d949.10.17_N133DN138T_SOSIPv5.2.8gp160 (Amino acid). FIG. 52A discloses SEQ ID NO: 545. FIG. 52B shows an alignment of CH848d949.10.17_N133DN138T_SOSIPv5.2.8gp160 and CH848d949.10.17_N133DN138T_SOSIPv5.2.8. FIG. 52B discloses SEQ ID NOS 531, 545 and 582, respectively, in order of appearance.

Figure 53B:
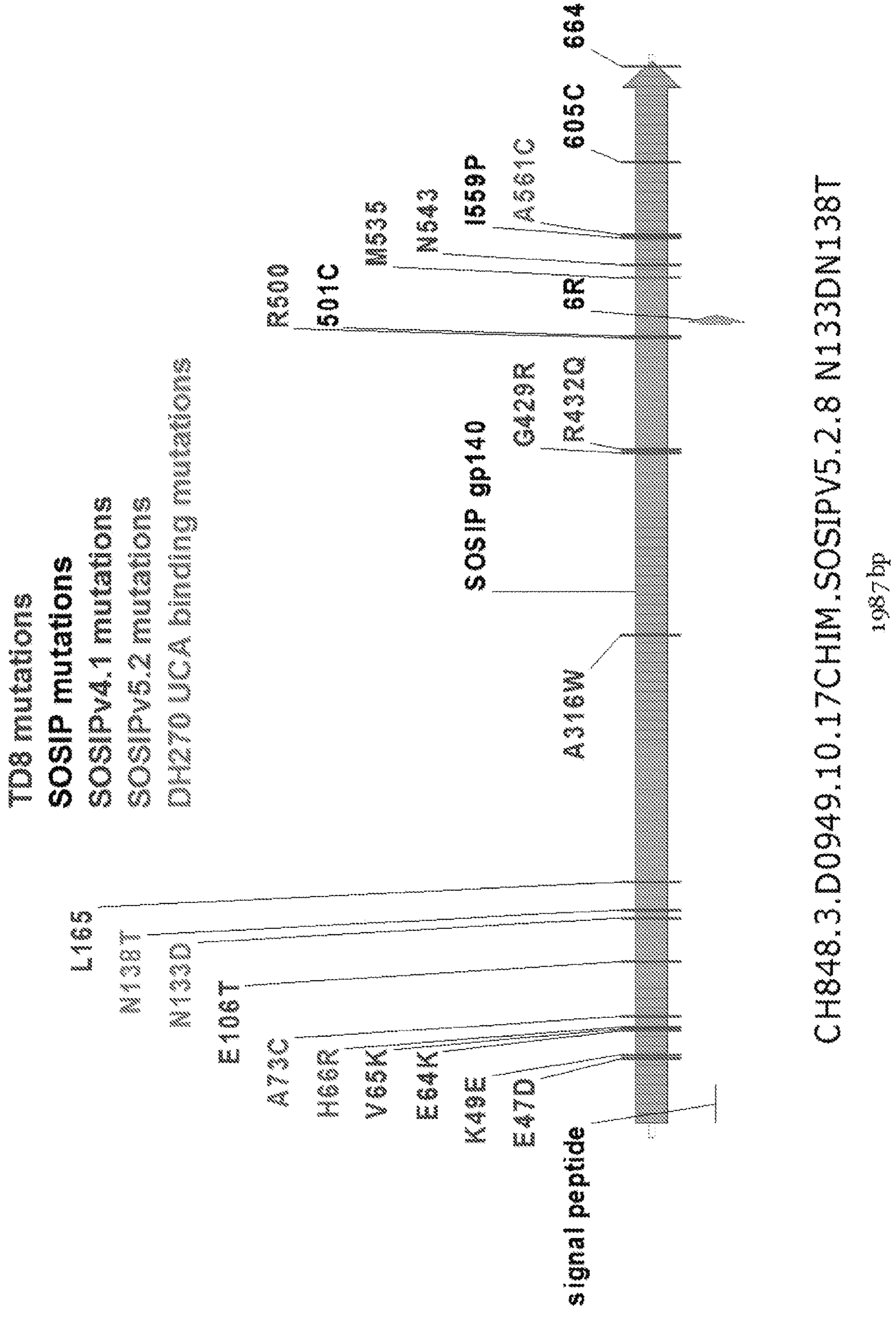
Figure 53C:
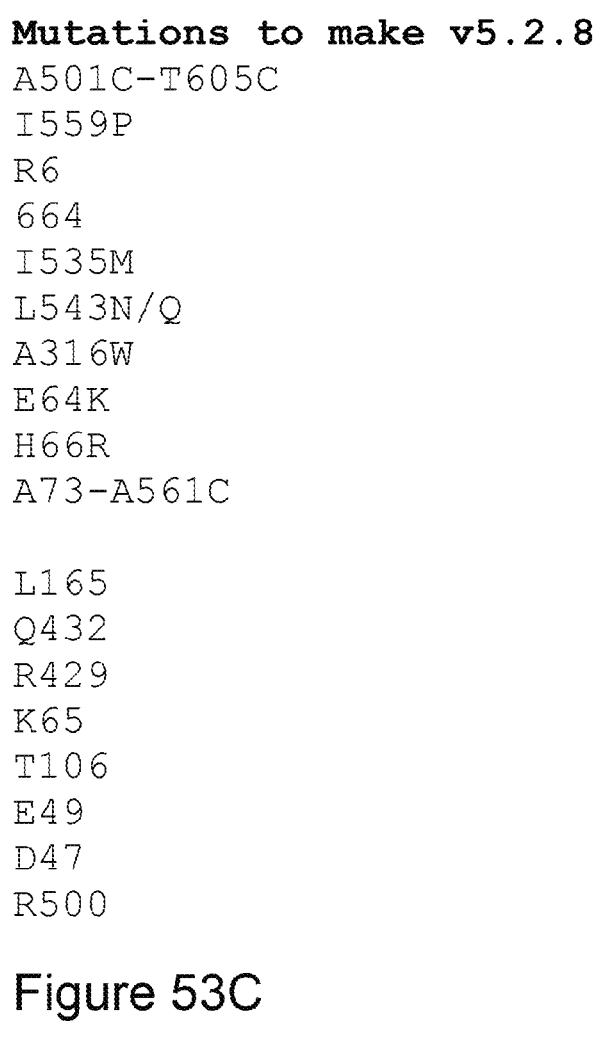
Figure 53E:
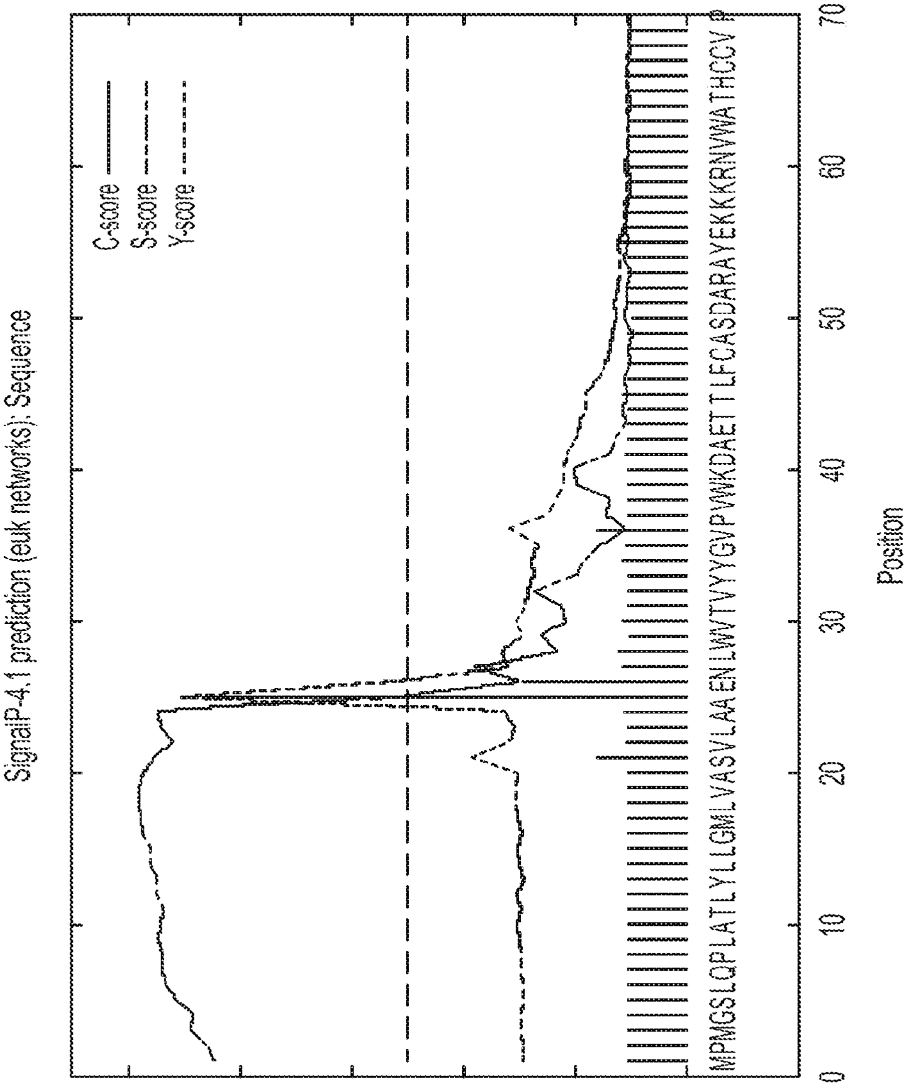
Figure 55A:
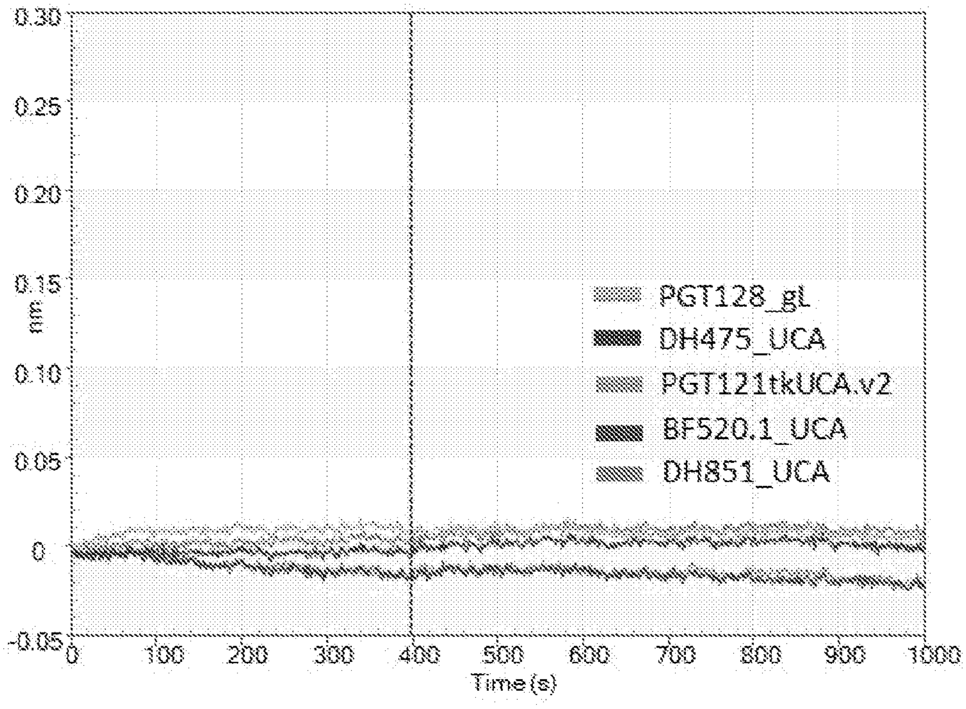
Figure 55B:
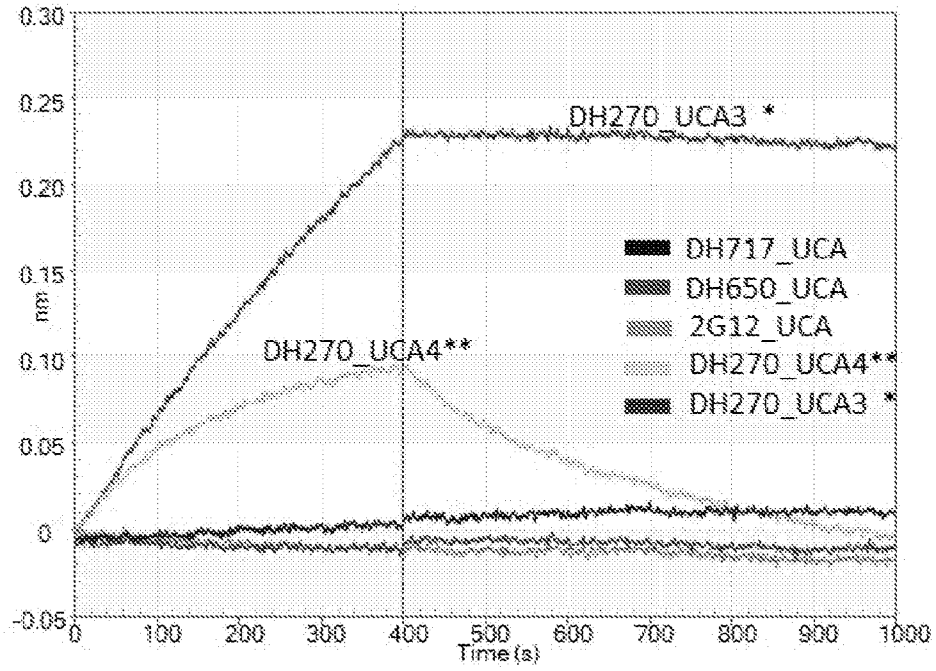
Figure 55C:
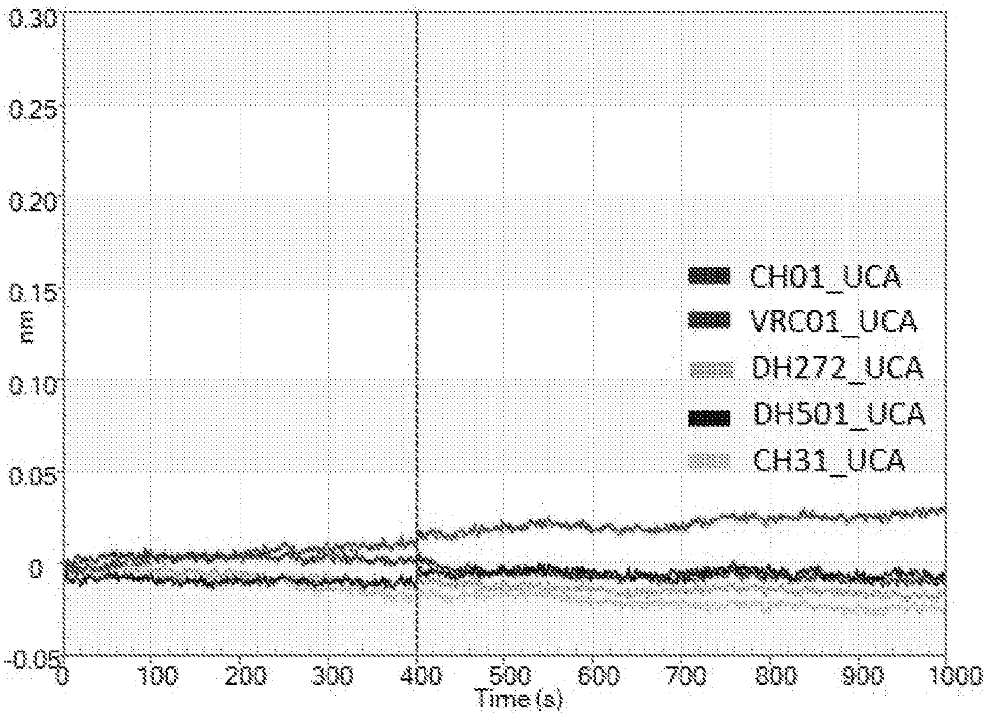
Figure 55D:
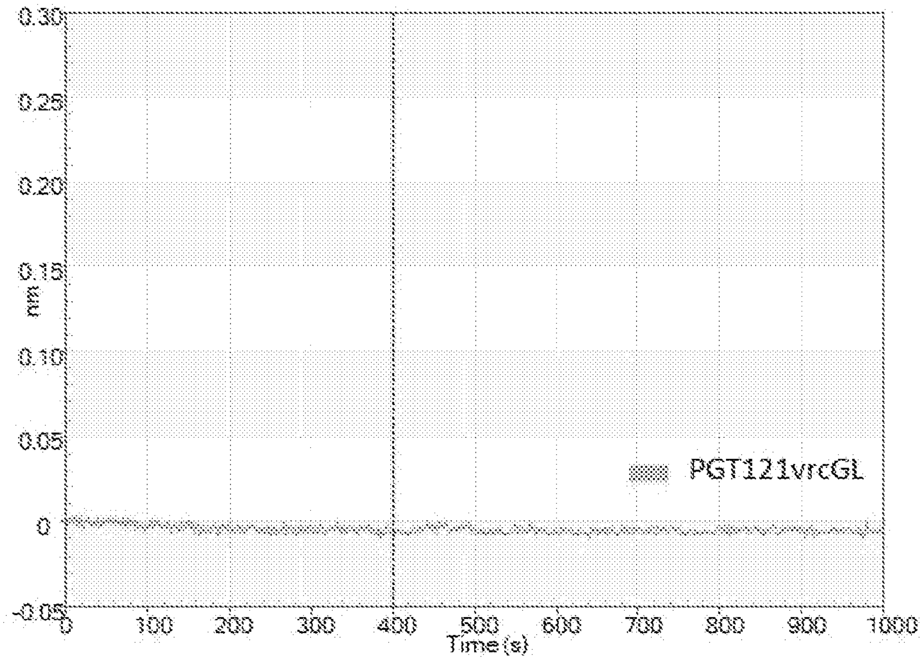
Figure 56A:
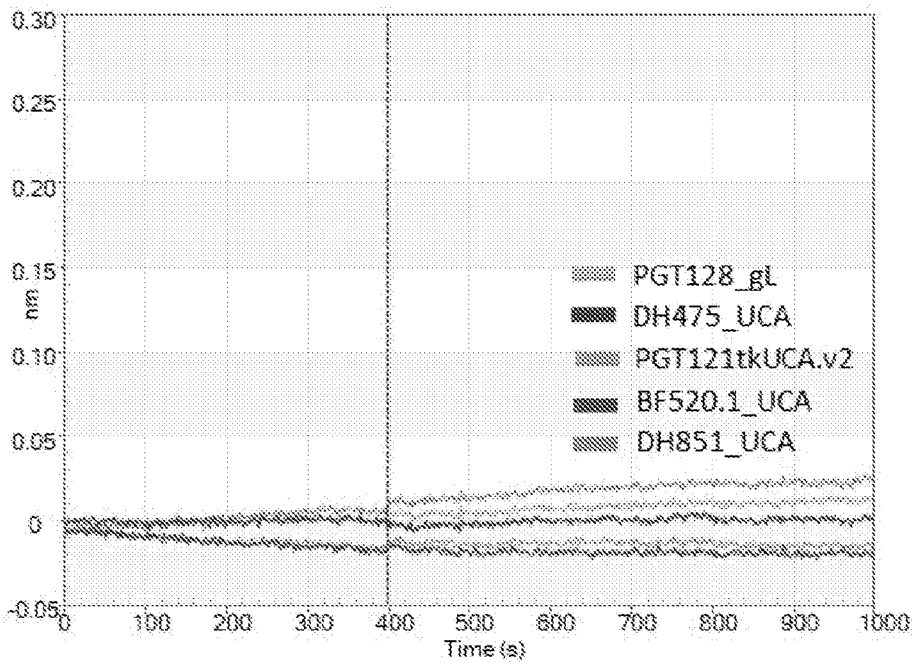
Figure 56B:
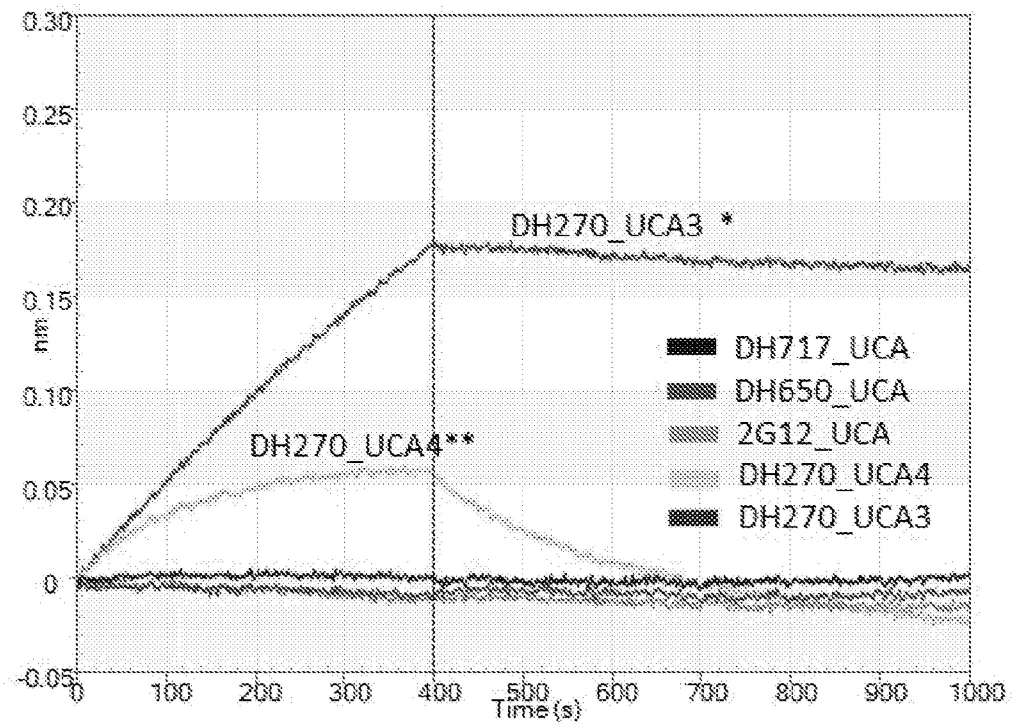
Figure 56C:
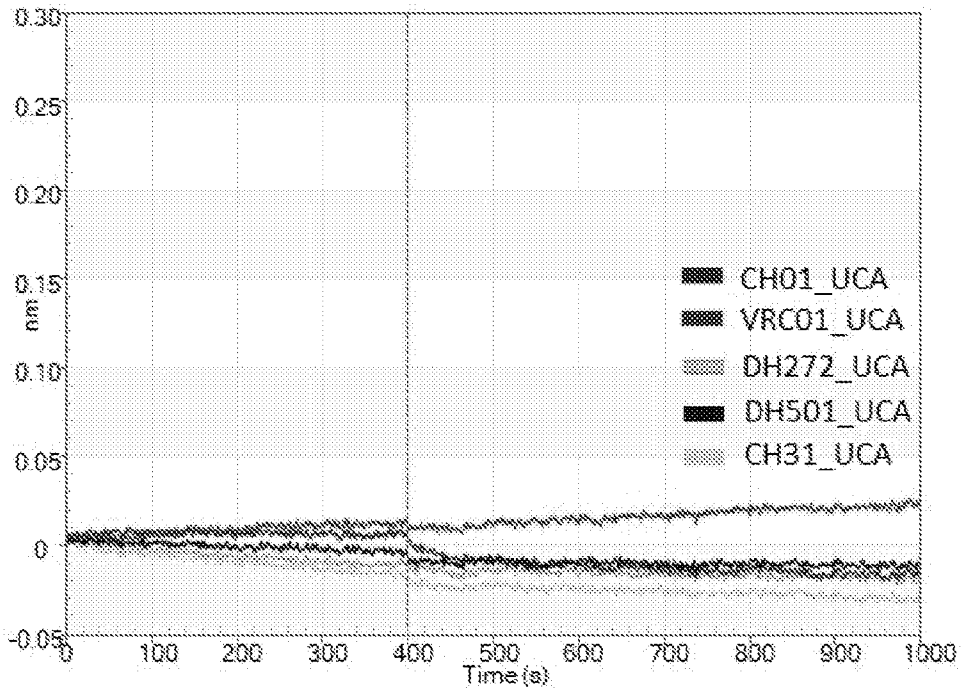
Figure 56D:
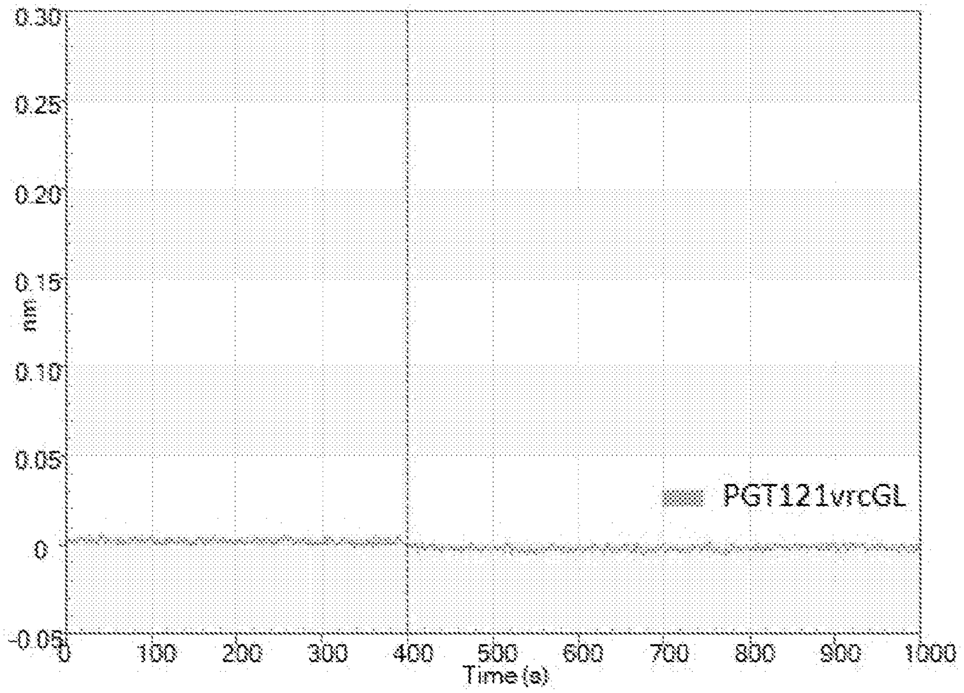
Figure 57A:
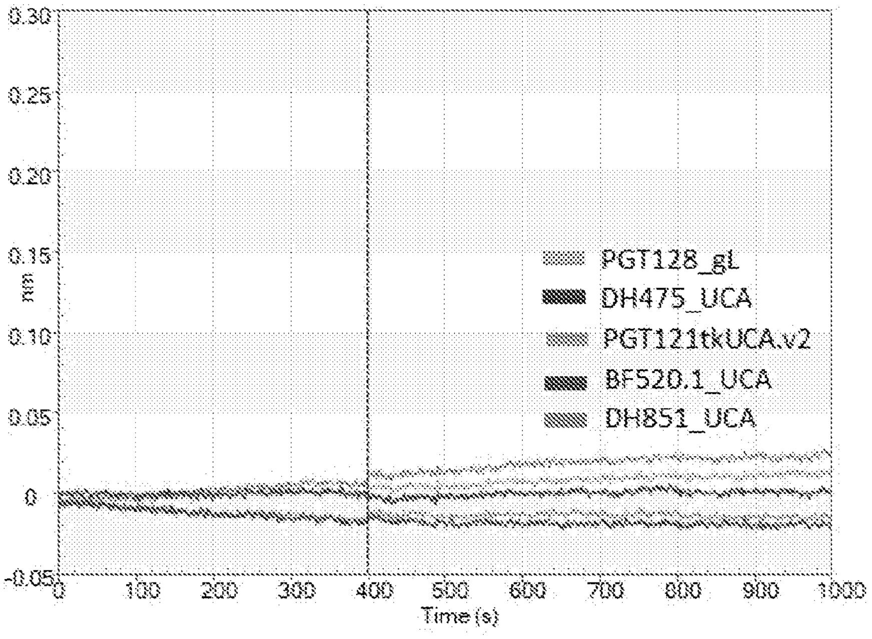
Figure 57B:
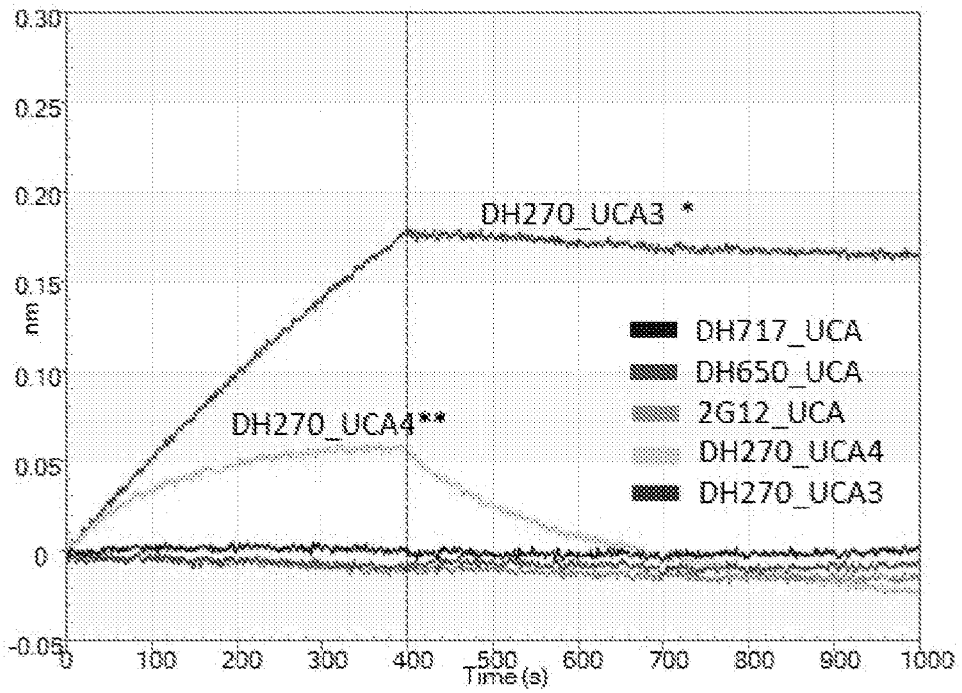
Figure 57C:
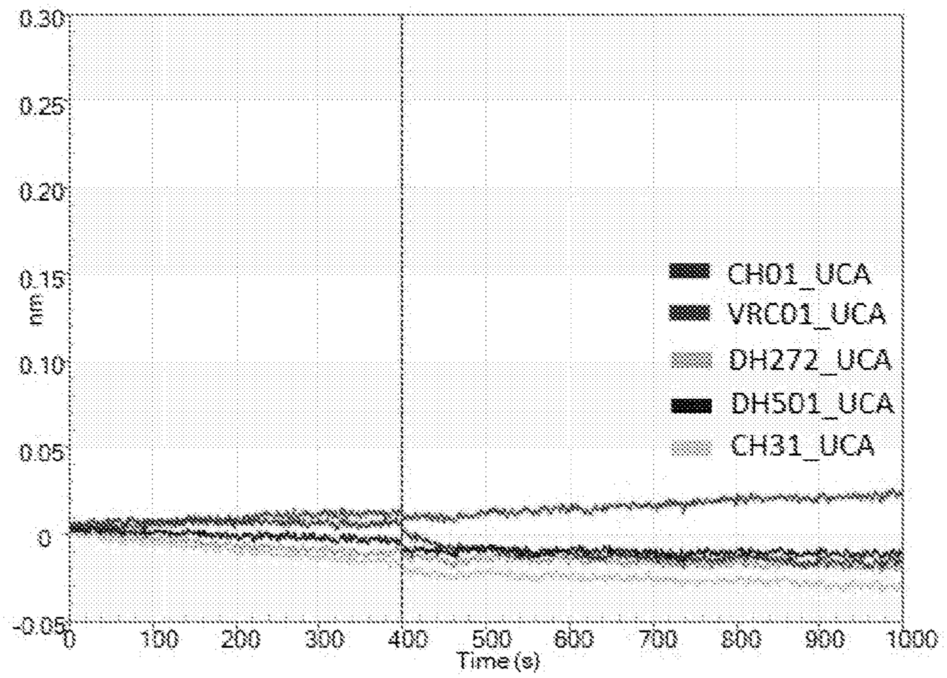
Figure 57D:
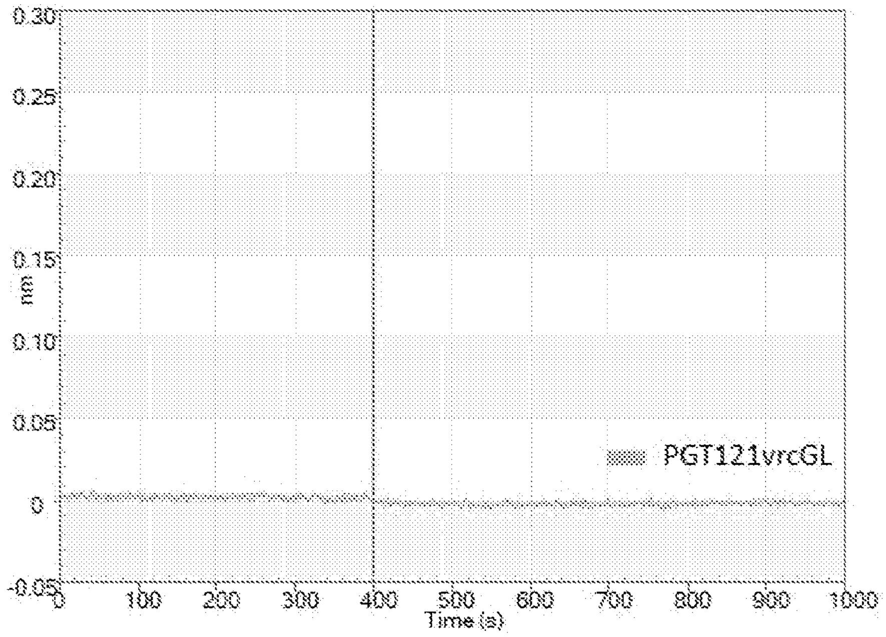

FIG. 53A shows sequence of CH848.3.D0949.10.17CHIM.SOSIPV5.2.8_N133DN138T. FIG. 53A discloses SEQ ID NO: 531. FIG. 53B shows schematic diagram with various positions and mutations to make SOSIP, SOSIP v4.1, SOSIP v5.2, TD8 mutations. FIG. 53C lists mutations to make SOSIP v.5.2.8. FIG. 53D shows an alignment of various envelopes. FIG. 53D discloses SEQ ID NOS 546-547, 531 and 583, respectively, in order of appearance. FIG. 53E shows signal peptide prediction from a signal peptide prediction server Signal P-4.1. FIG. 53E discloses SEQ ID NO: 548.

FIG. 54A-C show various amino acid sequences. FIG. 54A discloses SEQ ID NOS 549-552, respectively, in order of appearance. FIG. 54B discloses SEQ ID NOS 551-552, respectively, in order of appearance. FIG. 54C discloses SEQ ID NOS 553-554, respectively, in order of appearance.

FIG. 54D depicts a schematic diagram of CH848.3.D949.10.17_N133DN138TchimericTD8.DS.SOSIP. FIG. 54E shows an annotated amino acid sequence of CH848.3.D949.10.17_N133DN138TchimericTD8.DS.SOSIP. FIG. 54E discloses SEQ ID NO: 553. FIG. 54F displays an alignment of amino acid sequences in FIGS. 54A, B and C. FIG. 54F discloses SEQ ID NOS 551, 549, 553, 552, 550, 554 and 555, respectively, in order of appearance.

FIG. 55A-D shows binding data for a trimer comprising CH848.3.D0949.10.17chim.6R.DS.SOSIP.664_N133D_N138T produced in 293F cells. BLI sensor tips were coated with different bnAb precursors. Two DH270 UCA precursors were inferred (See e.g. FIG. 21) and binding to CH0848 Envelope in solution was examined with BLI. Both DH270 UCAs bound to the Env. DH270 UCA3 bound at a higher magnitude and had a low dissociation rate so once it is bound it remains engaged with Env. V3 glycan bnAb precursors PGT121 and PGT128 did not bind. BnAb precursors to bnAb epitopes with the CD4bs, V1V2 glycan did not bind to this trimer.

FIG. 56A-D shows binding for a trimer comprising CH848.3.D0949.10.17CHIM.6R.SOSIP.664V4.1_N133DN138T produced in 293F cells. BLI sensor tips were coated with different bnAb precursors. Two DH270 UCA precursors were inferred (See e.g. FIG. 21) and binding to CH0848 Envelope in solution was examined with BLI. Both DH270 UCAs bound to the Env. DH270 UCA3 bound at a higher magnitude and had a low dissociation rate so once it is bound it remains engaged with Env. V3 glycan bnAb precursors PGT121 and PGT128 did not bind. BnAb precursors to bnAb epitopes with the CD4bs, V1V2 glycan did not bind to this trimer.

FIG. 57 A-D shows binding data for a trimer comprising CH848.3.D0949.10.17SOFA.DS.chSOSIP_N133N138A produced in 293F cells. BLI sensor tips were coated with different bnAb precursors. Two DH270 UCA precursors were inferred (See e.g. FIG. 21) and binding to CH0848 Envelope in solution was examined with BLI. Both DH270 UCAs bound to the Env. DH270 UCA3 bound at a higher magnitude and had a low dissociation rate so once it is bound it remains engaged with Env. V3 glycan bnAb precursors PGT121 and PGT128 did not bind. BnAb precursors to bnAb epitopes with the CD4bs, V1V2 glycan did not bind to this trimer.

Figure 58:
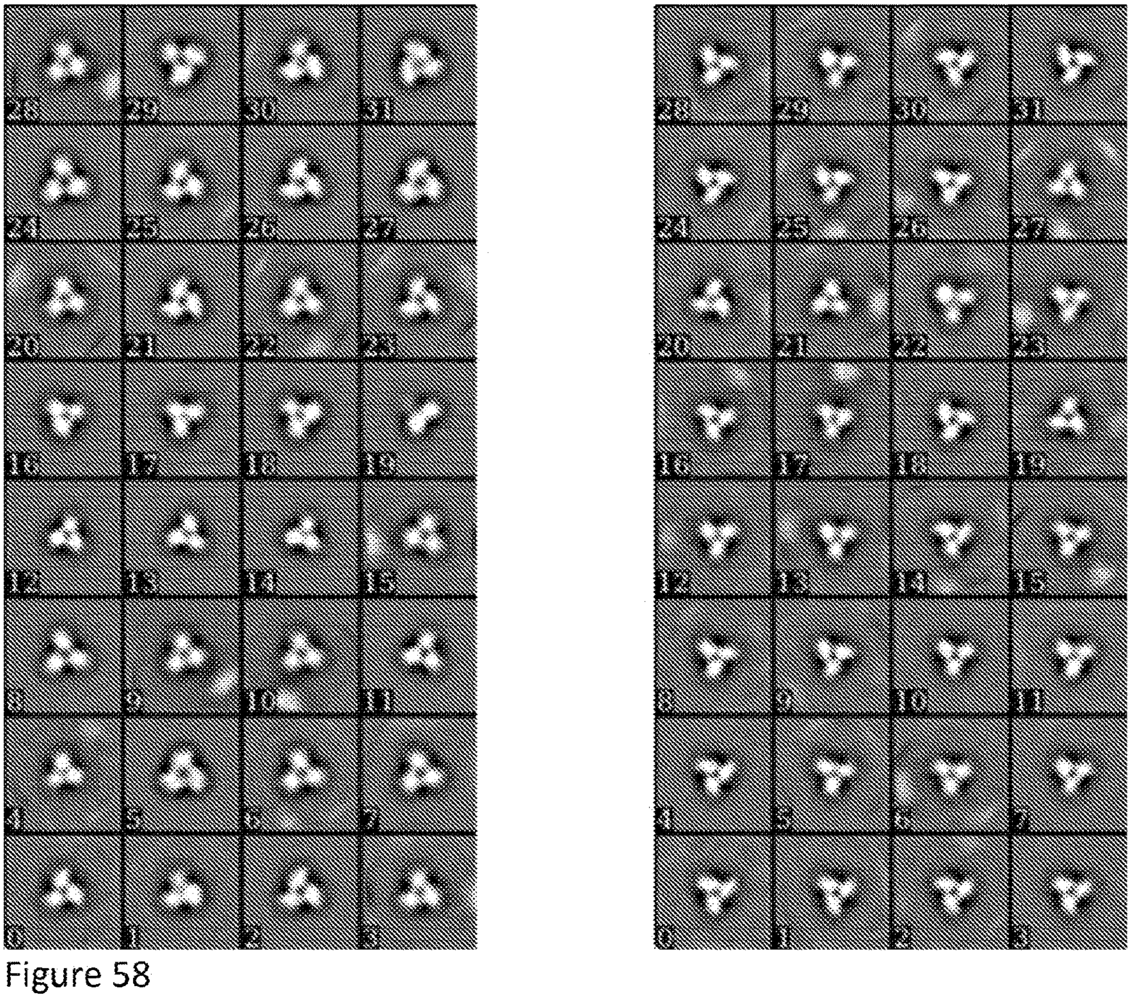

FIG. 58 shows CH0848.D0949.10.17 SOSIP trimer formation. Deglycosylated trimer in FIGS. 58-69 is CH848.3.D0949.10.17CHIM.6R.SOSIP.664V4.1_N133DN138T.

Figures 59, 60:
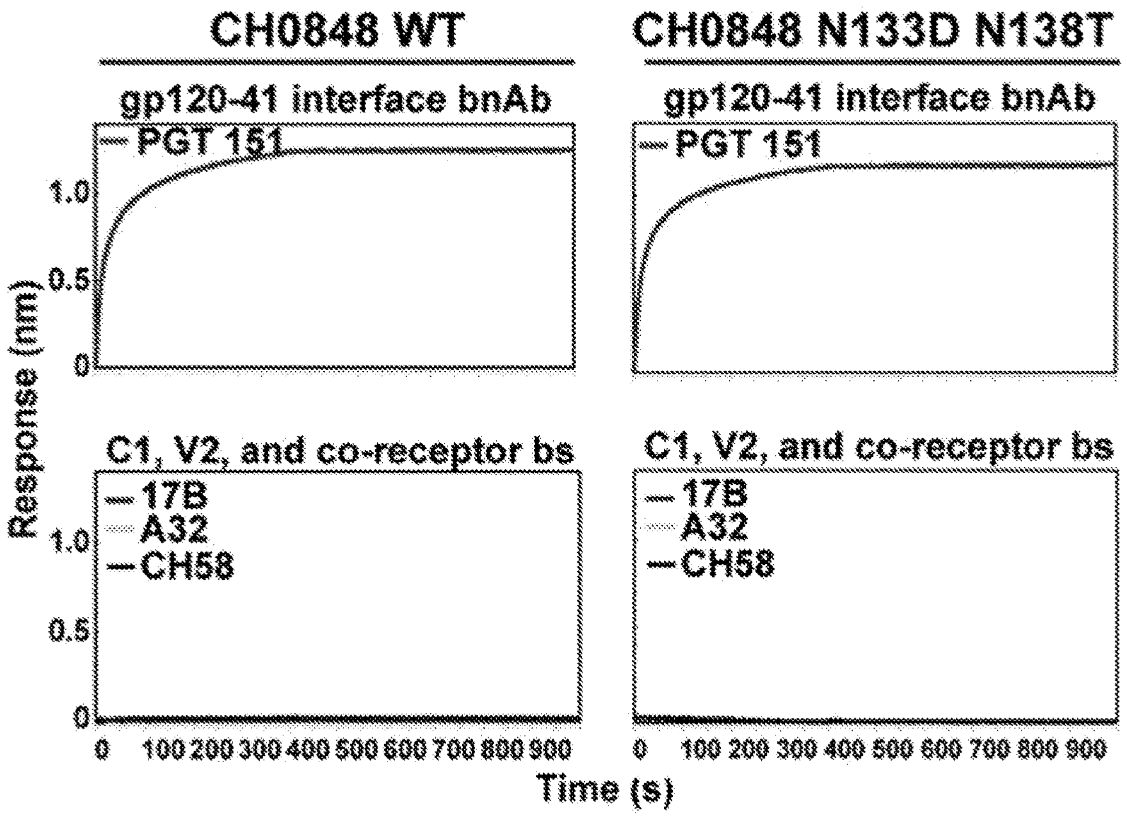

FIG. 59 shows that CH0848 trimers are antigenic for cleaved trimer specific bnAb PGT151, but not coreceptor Ab 17B. "WT" refers to trimer design without N133 and N138 changes.

FIG. 60 shows that DH270 UCA binds SOSIP trimers, but not uncleaved gp140 oligomers or monomeric gp120.

Figures 61A, 61B:
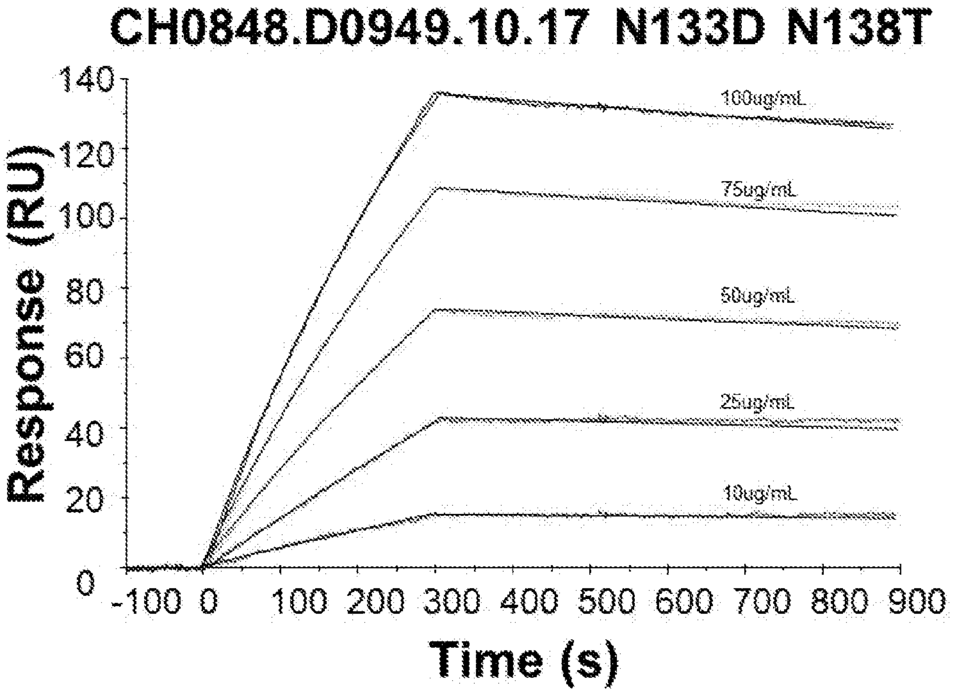

FIGS. 61A and 61B show that CH0848 10.17 N133D N138T SOSIP engages the DH270 UCA Fab with 29 nM affinity.

FIG. 62 shows effect of V1 glycans on virus neutralization. FIG. 62A shows that V1 glycans inhibit DH270 UCA recognition of native Env trimers: Autologous Env CH0848.3.D949.10.17 possessed a short V1 loop (17aa); N133D and N138T mutations removed potential N-linked glycosylation sites within the V1 loop. FIG. 62B shows DH270UCA does not neutralize all viruses lacking V1 glycans. JR-FL N135Q N137Q N141Q SOSIPs also showed no binding to the DH270 UCA. Negative control virus MuLV titers were >50 μg/mL.

Figure 63:
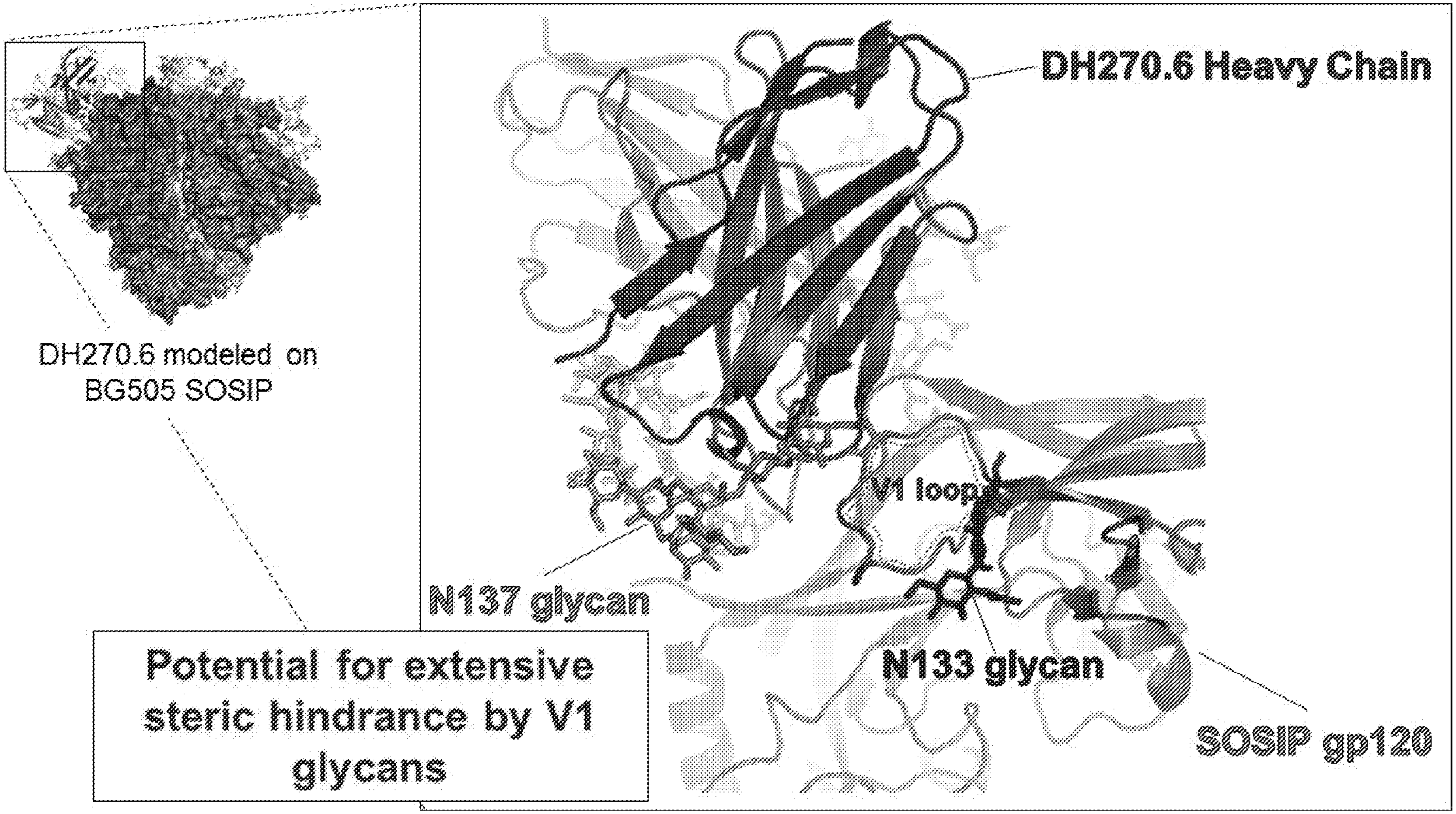

FIG. 63 is a model of DH270.6 binding to SOSIP trimer and shows potential N137 glycan interference. DH270 structure in complex with Man9-V3 glycopeptide (Fera D. et al., Nature Communication in press) is modeled onto BG505 SOSIP gp120 from Stewart-Jones et al. Cell 2016 (PDB: 5FYL).

Figure 64:
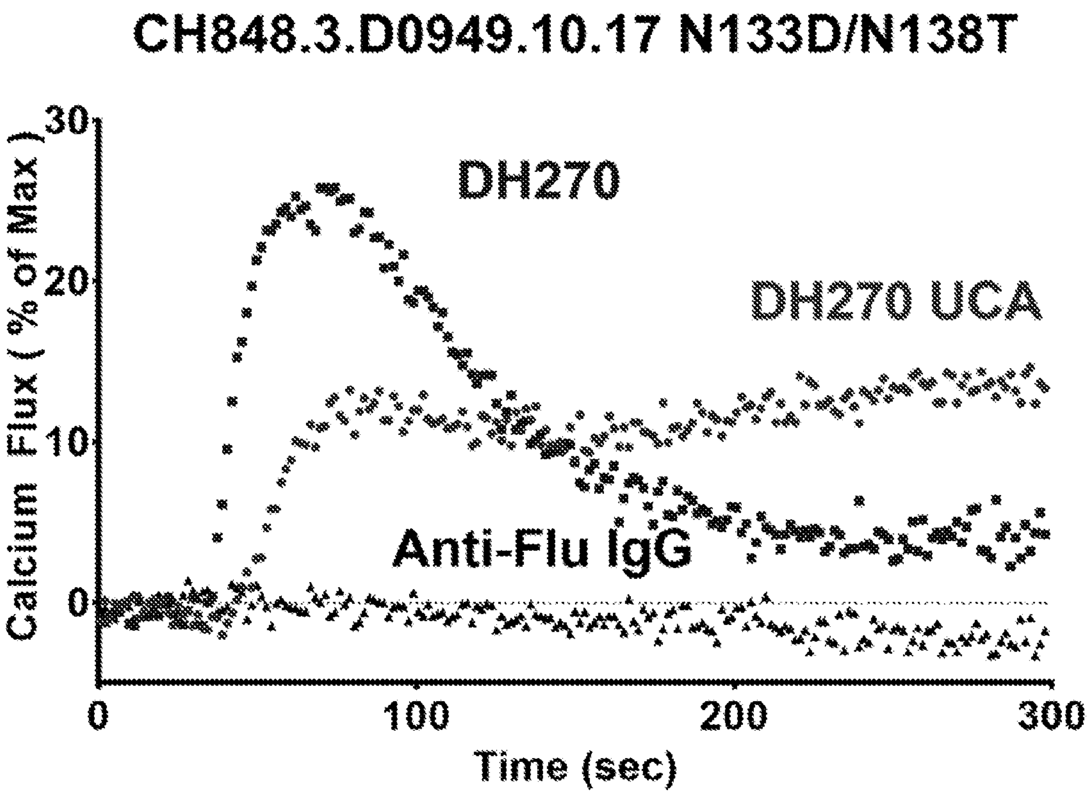

FIG. 64 shows that CH0848 N133D N138T SOSIP induces Ca2+ flux in DH270 UCA and DH270 Ramos cell lines.

Figure 65:
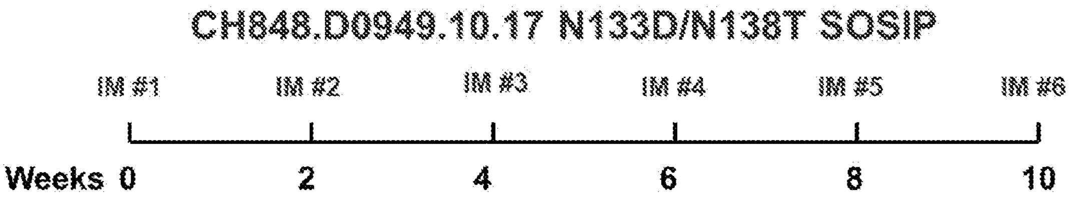

FIG. 65 shows DH270 UCA knock-in (DH270 UCA3 $VH^{+/-}$, DH270 UCA $VL^{+/-}$) mice SOSIP immunization regimen—Heterozygous pre-rearranged DH270 UCA knock-in mice. Protein dose: 25 μg; Route: Intramuscular; Adjuvant: GLA-SE. Group 1: CH848 N133D/N138T SOSIP; Group 2: Adjuvant only.

Figure 66:
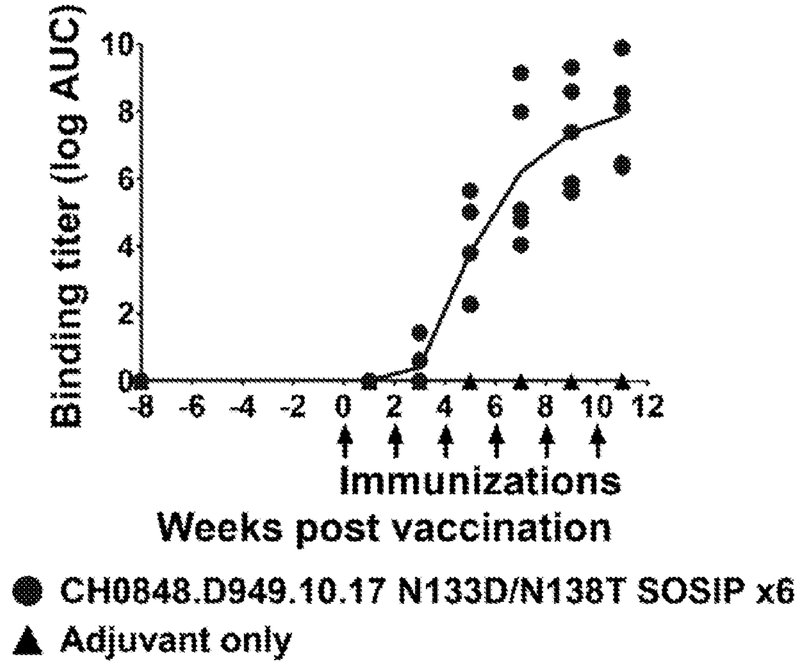

FIG. 66 shows immunization with N133D/N138T SOSIP induced SOSIP-binding antibodies in DH270 UCA knock in mice. Figure shows serum IgG binding to CH0848.D494.10.17 N133D N138T SOSIP.

Figure 67:
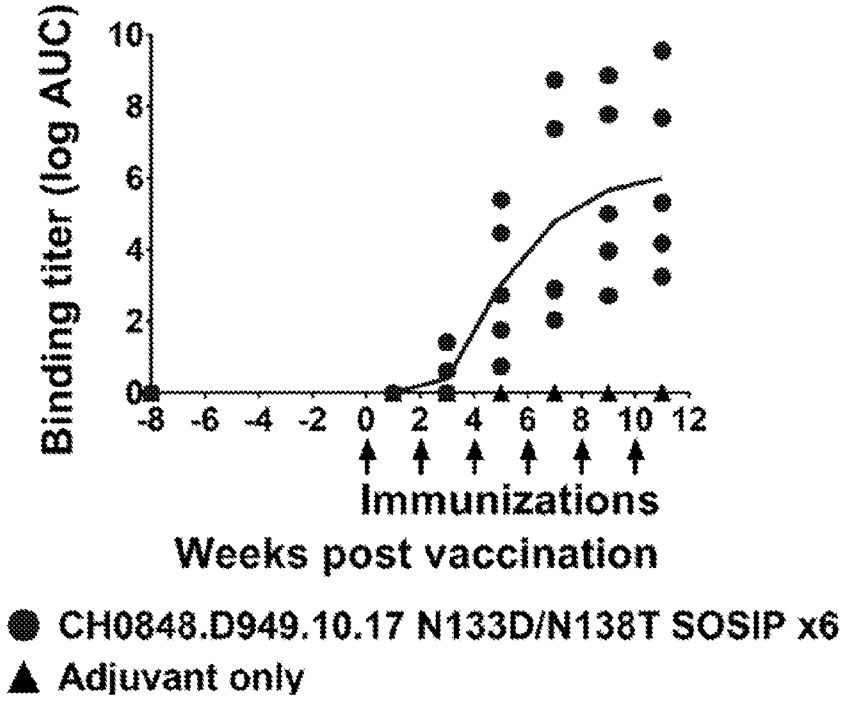

FIG. 67 shows that DH270 UCA knock-in mouse serum antibodies can bind to CH0848.D949.10.17 in the presence of N133 and N138 glycans. Figure shows serum IgG binding to CH0848.D494.10.17 SOSIP.

FIG. 68 show shows that DH270 UCA knock-in mouse sera neutralize CH0848.D0949.10.17 lacking the N133/N138 glycans.

FIG. 69 shows DH270 UCA knock-in mouse sera neutralize tier 2 virus CH0848.D0949.10.17 with N133/N138 glycan.

Figures 70, 71A:
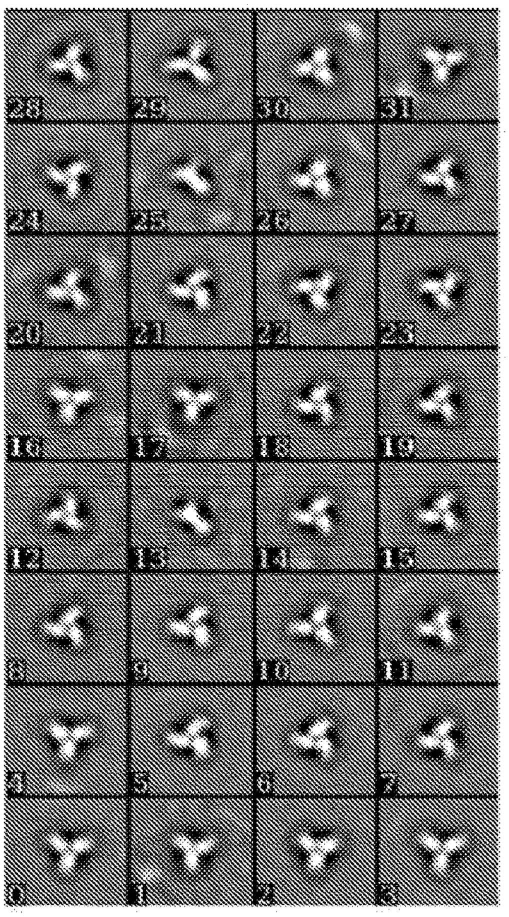

FIG. 70 shows JRFL, CH0848.D1305.10.19, and CH0848.D949.10.17 V3 loop alignment. FIG. 70 discloses SEQ ID NOS 556-558, respectively, in order of appearance.

Figure 71B:
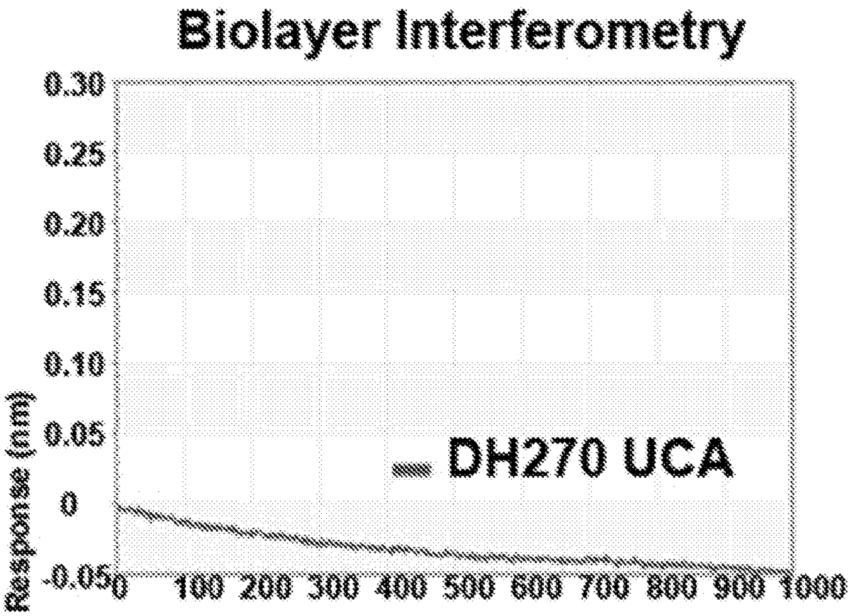
Figure 71C:
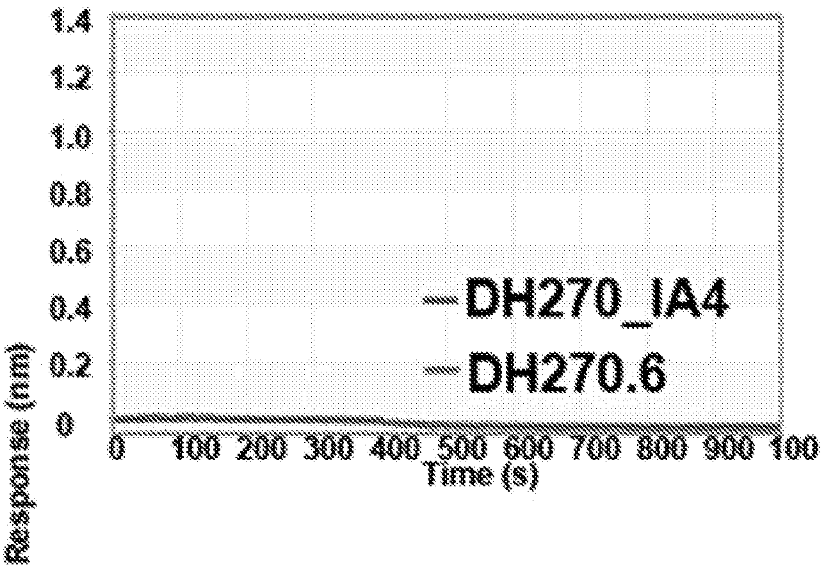

FIG. 71 shows that DH270 UCA does not bind CH0848 natural Env (CH0848.D1305.10.19) that has a 17 aa V1 loop and lacks N133 and N138 glycans. FIG. 71A shows trimer formation. FIGS. 71B and 71C shows antigenicity of CH0848.D1305.10.19 trimer to DH270UCA and DH270_I4 and DH270.6 (DH542).

Figure 72A:
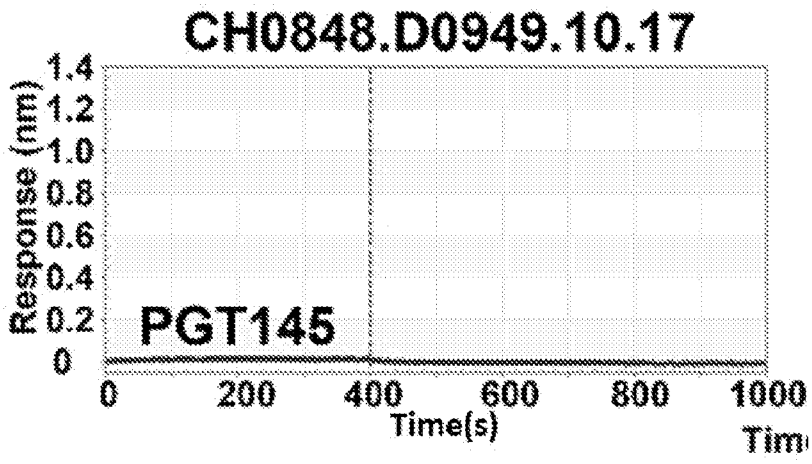
Figure 72B:
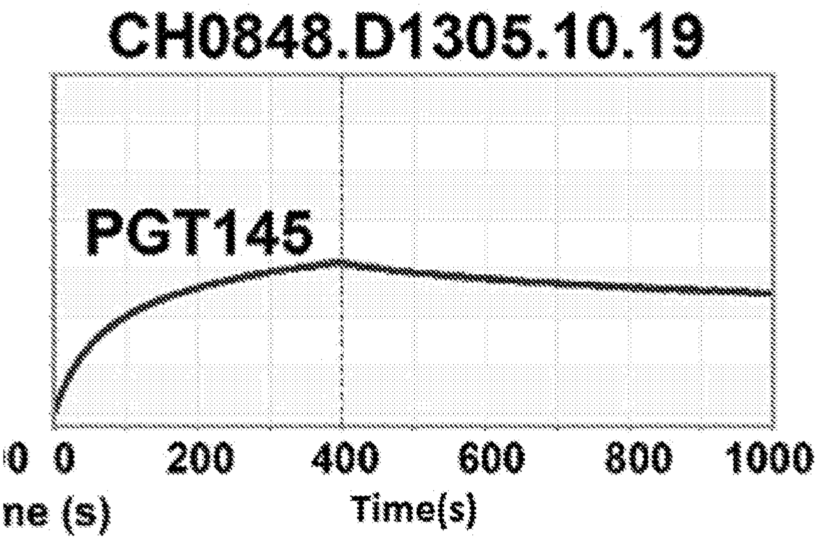

FIG. 72 shows that DH270-resistant CH0848 natural Env with a 17 aa V1 loop and no N133 and N138 glycan acquire V2 apex bnAb binding—Potential V3-glycan escape variant is recognized by V2 apex bnAbs (PGT145). FIG. 72A shows DH270-reactive envelope CH0848.D0949.10.17. FIG. 72B shows DH270-non reactive envelope CH0848.D1305.10.19.

Figure 73:
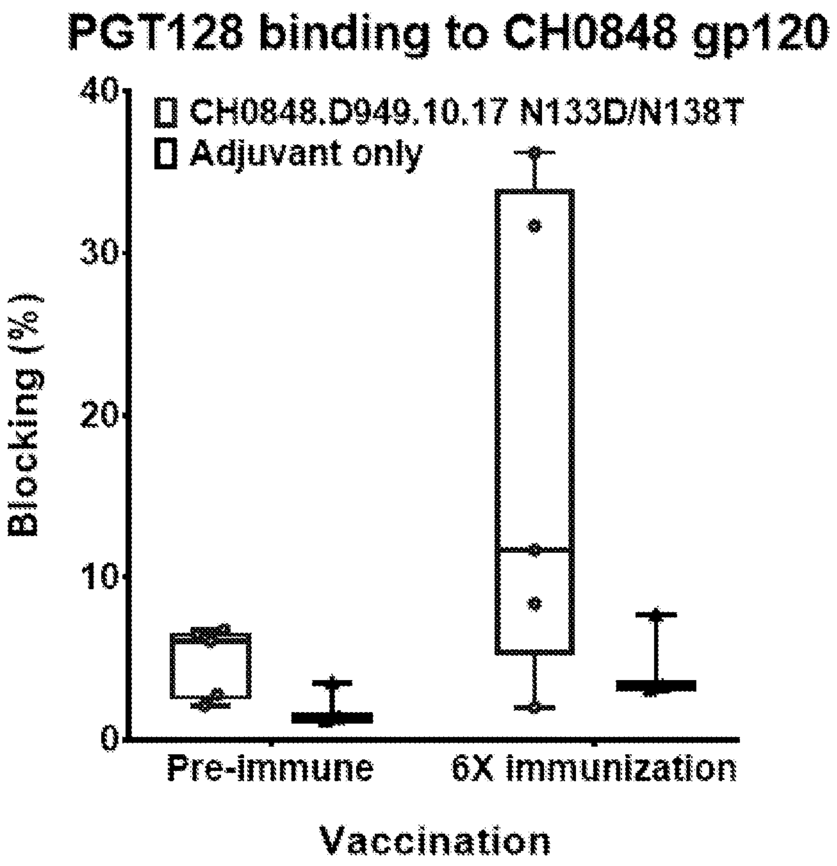
Figure 74A:
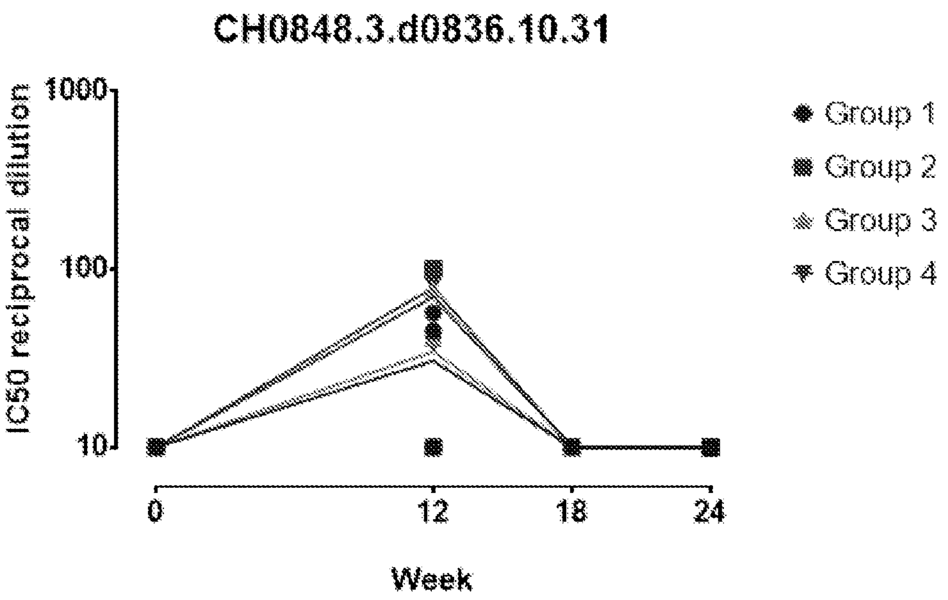
Figure 74B:
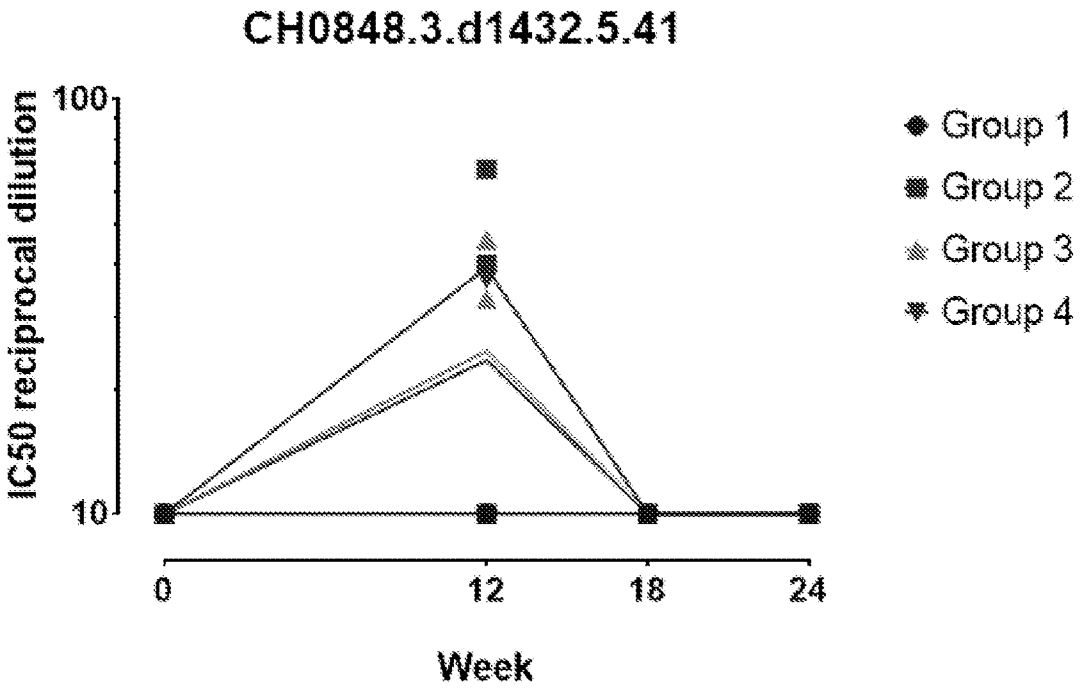
Figure 74C:
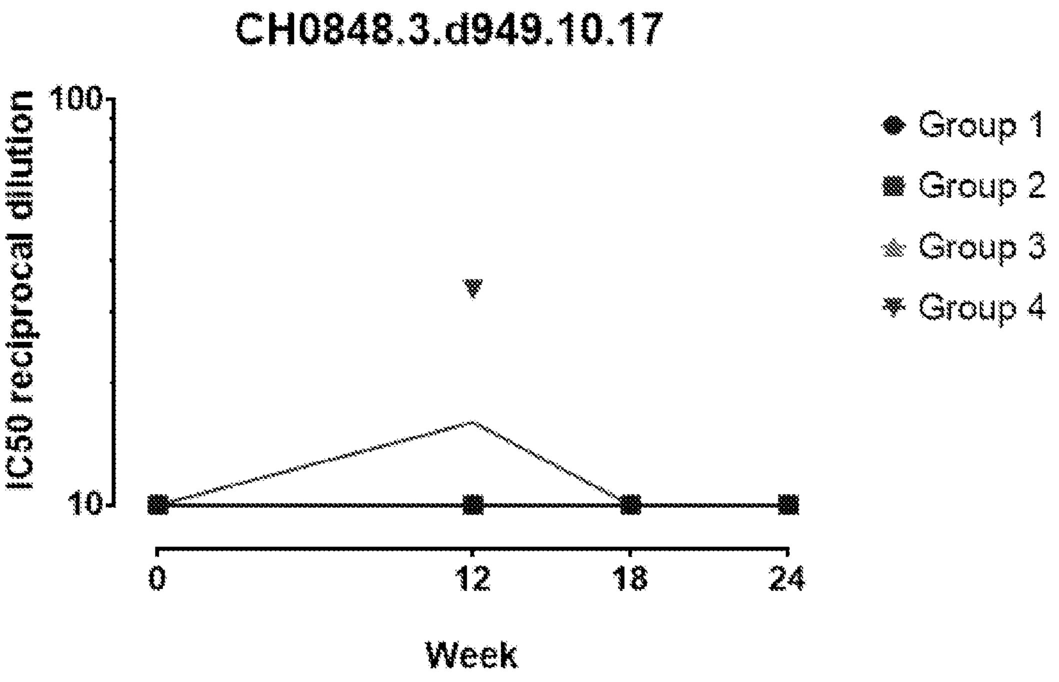
Figure 74D:
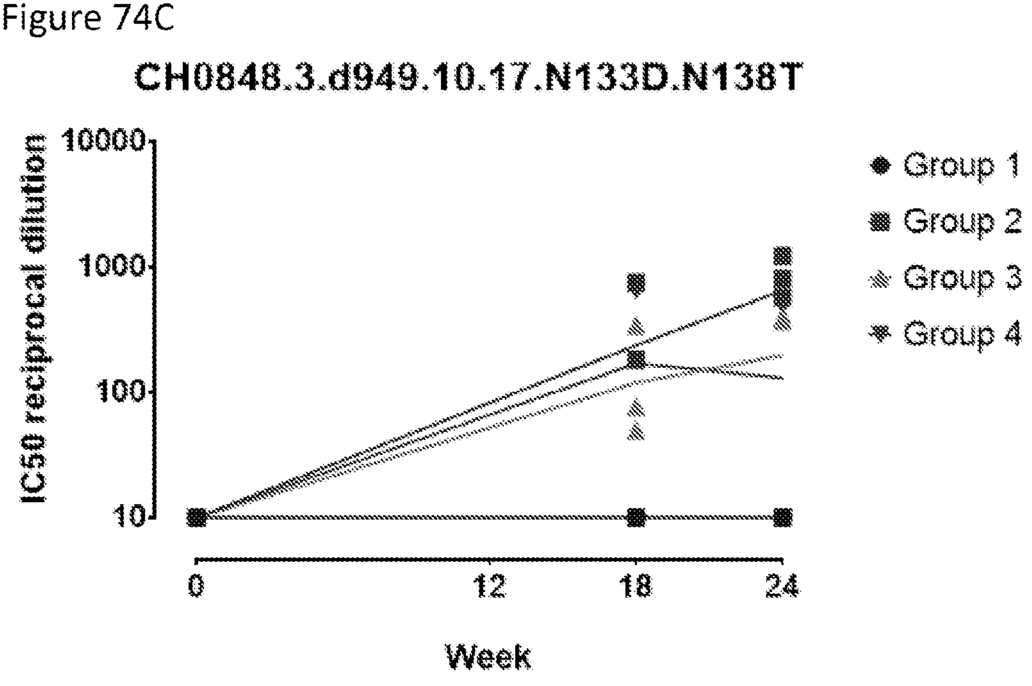
Figure 76A:
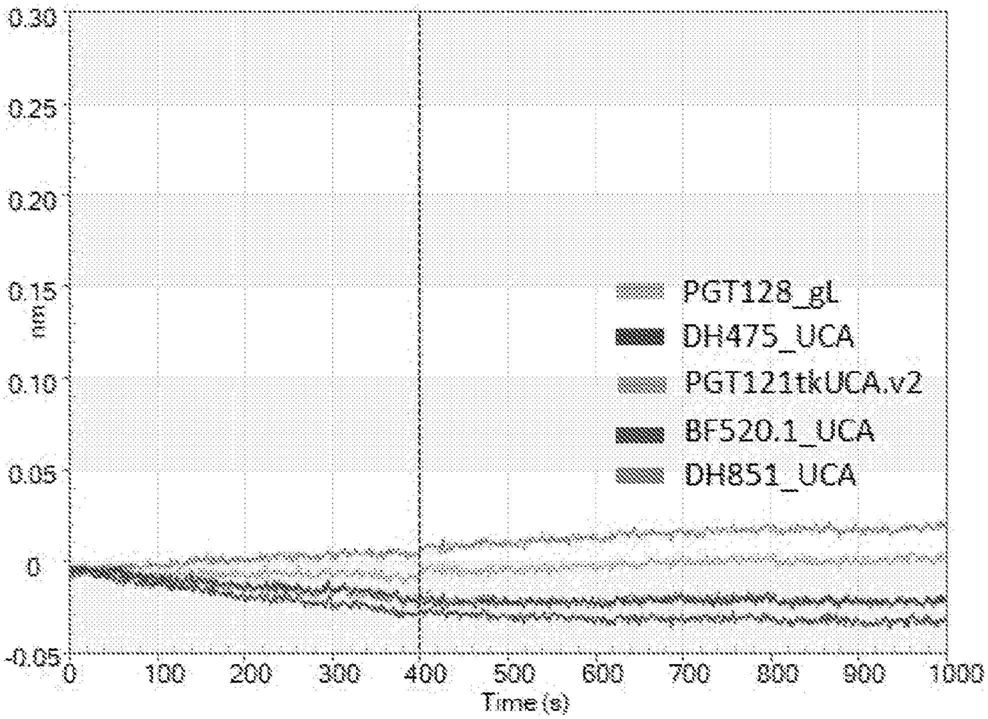
Figure 76B:
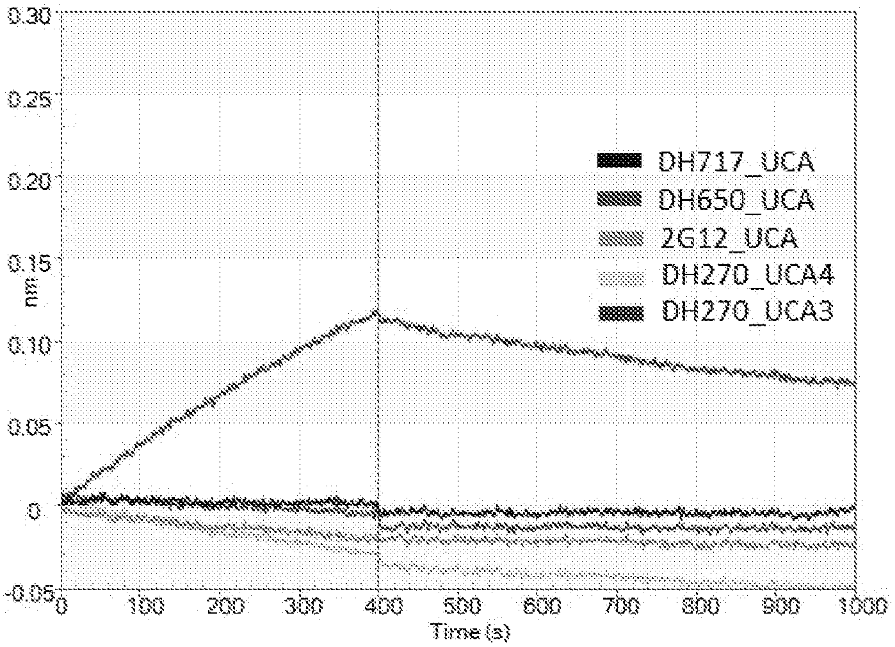
Figure 76C:
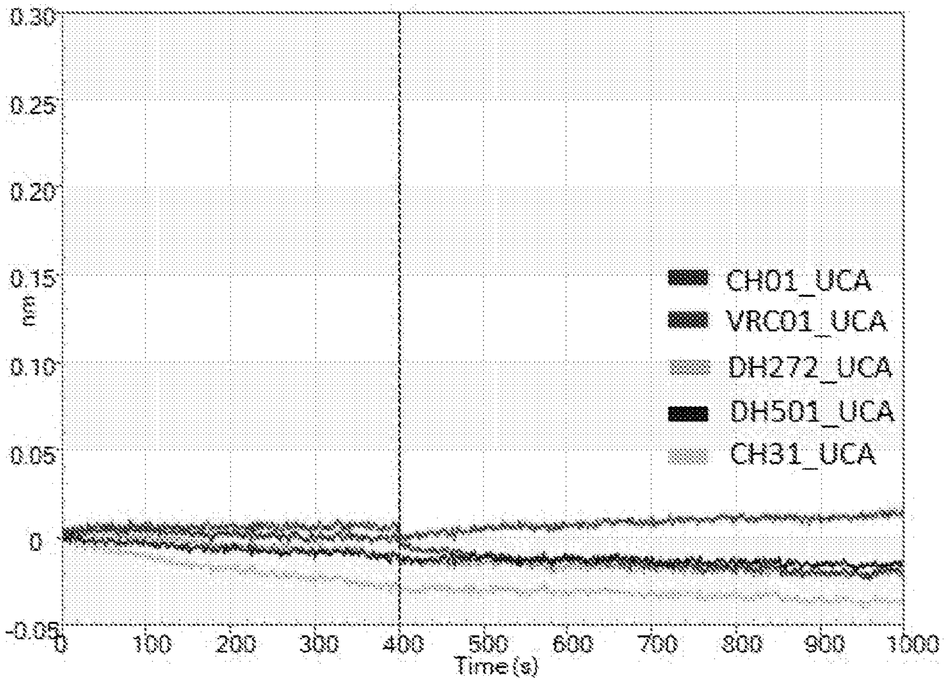
Figure 76D:
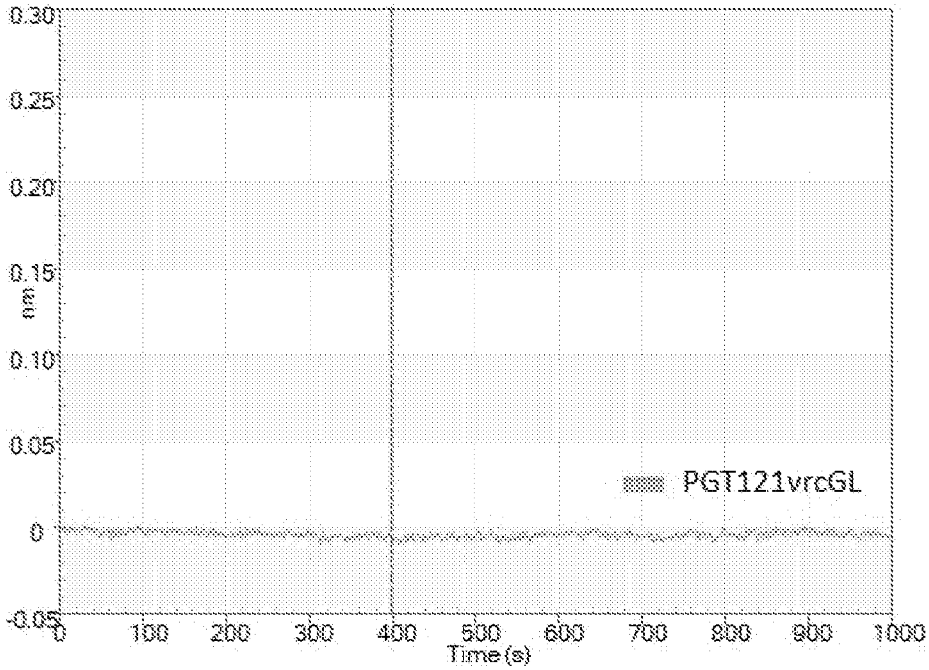
Figure 79A:
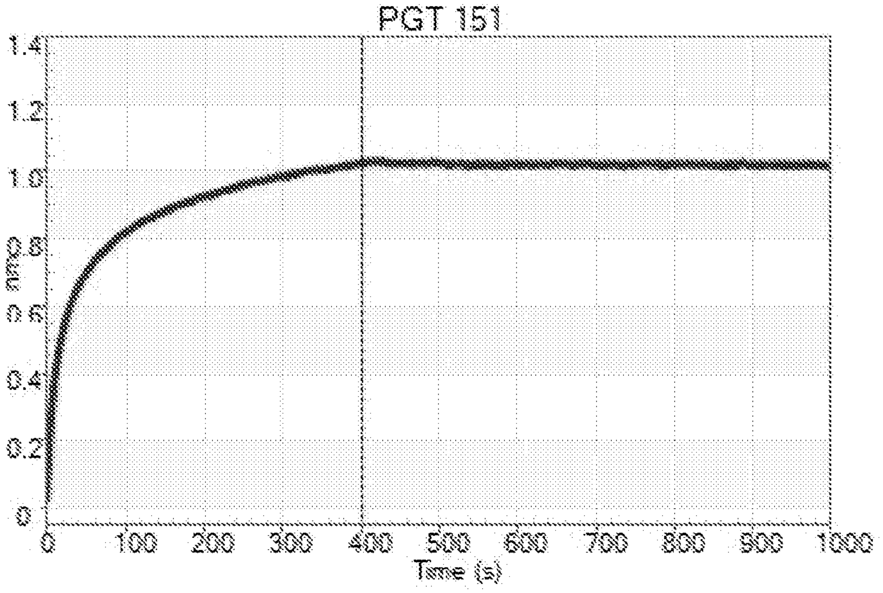
Figure 79B:
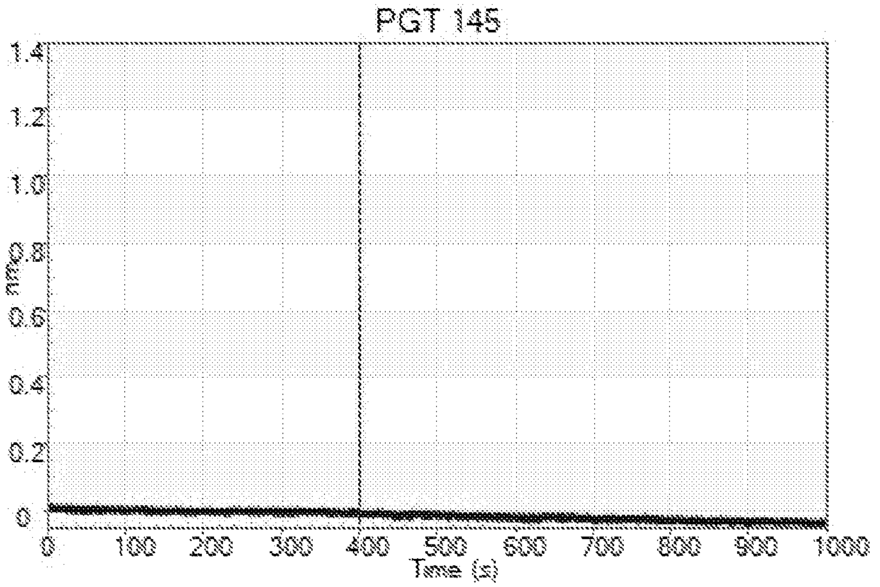
Figure 79C:
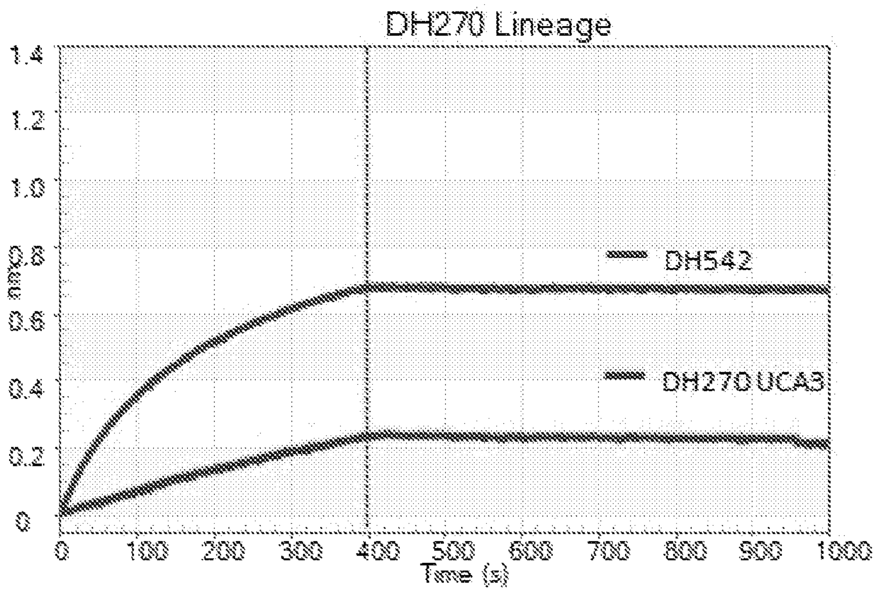
Figure 79D:
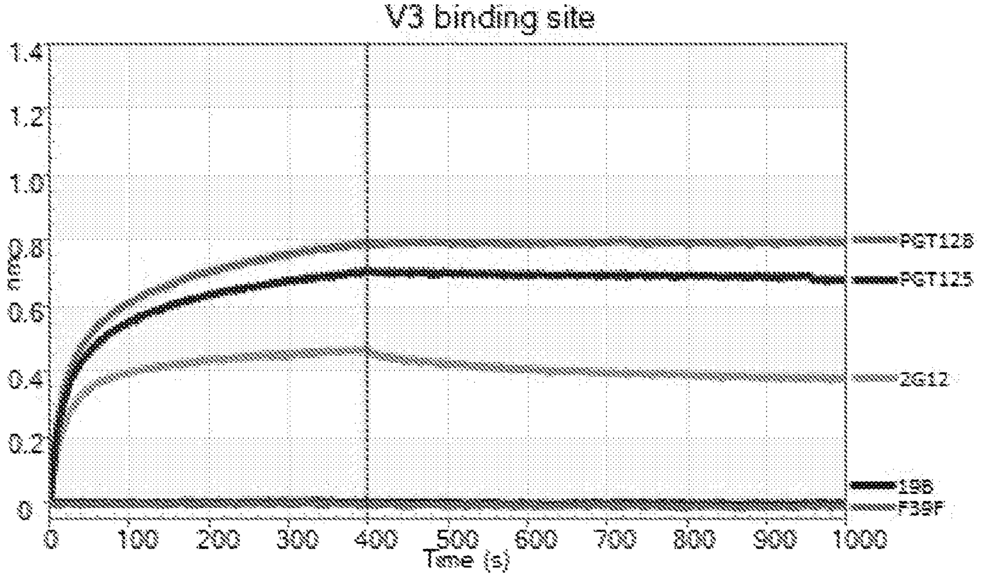
Figure 79E:
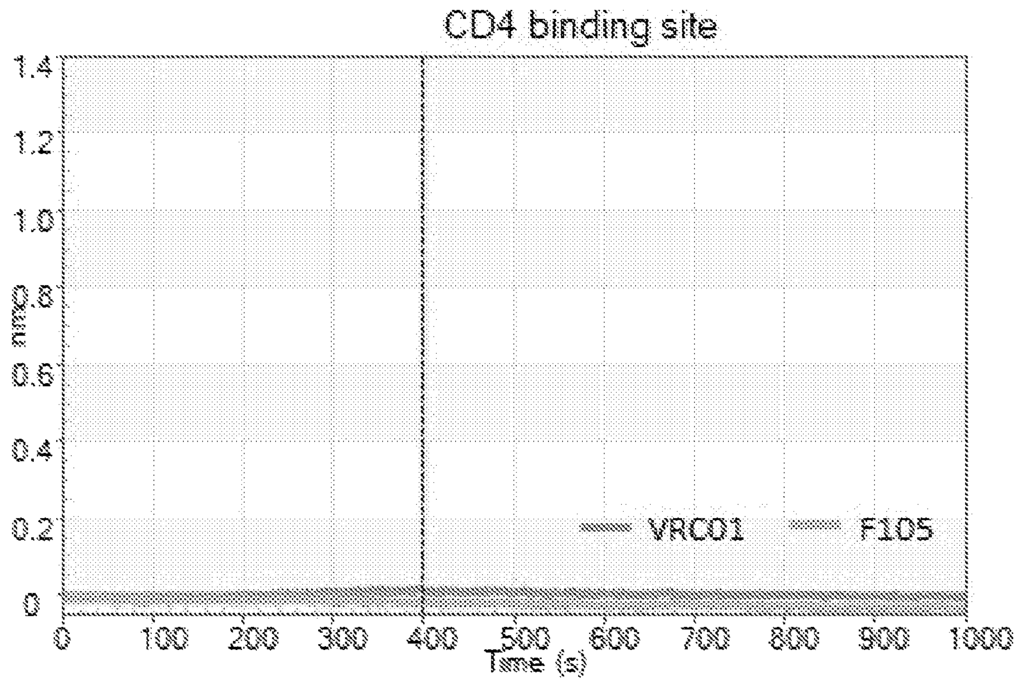
Figure 79F:
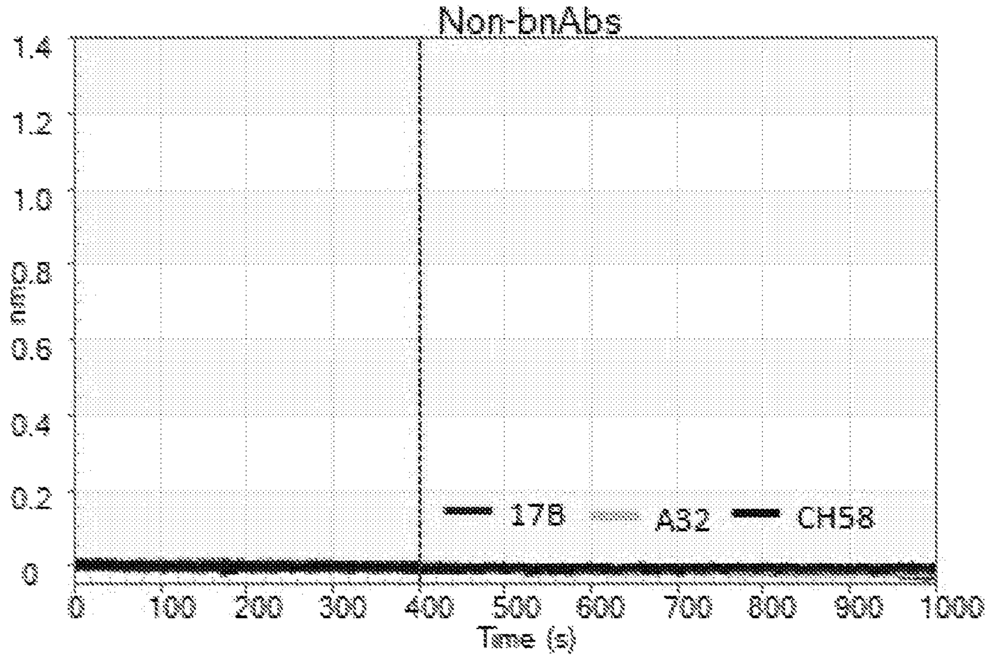
Figure 79G:
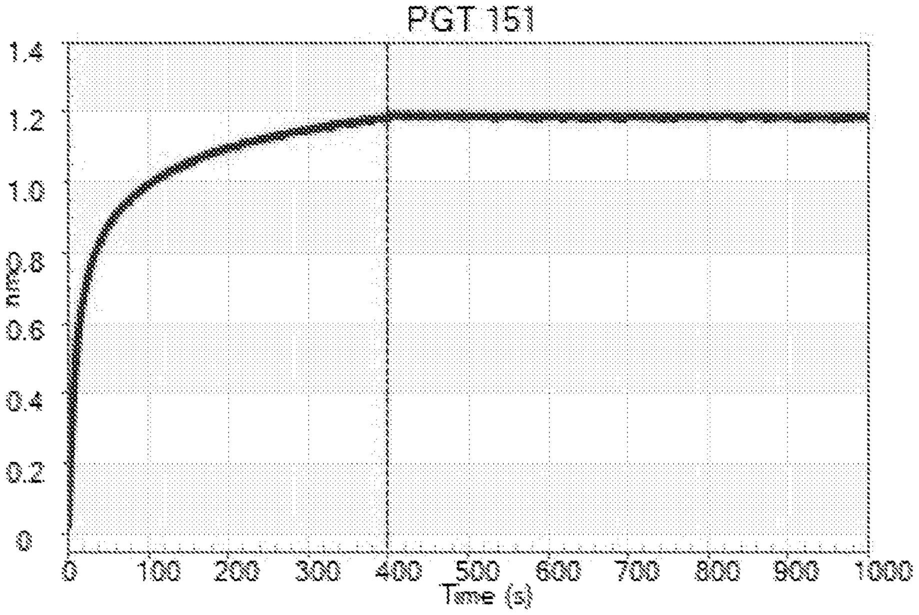
Figure 79H:
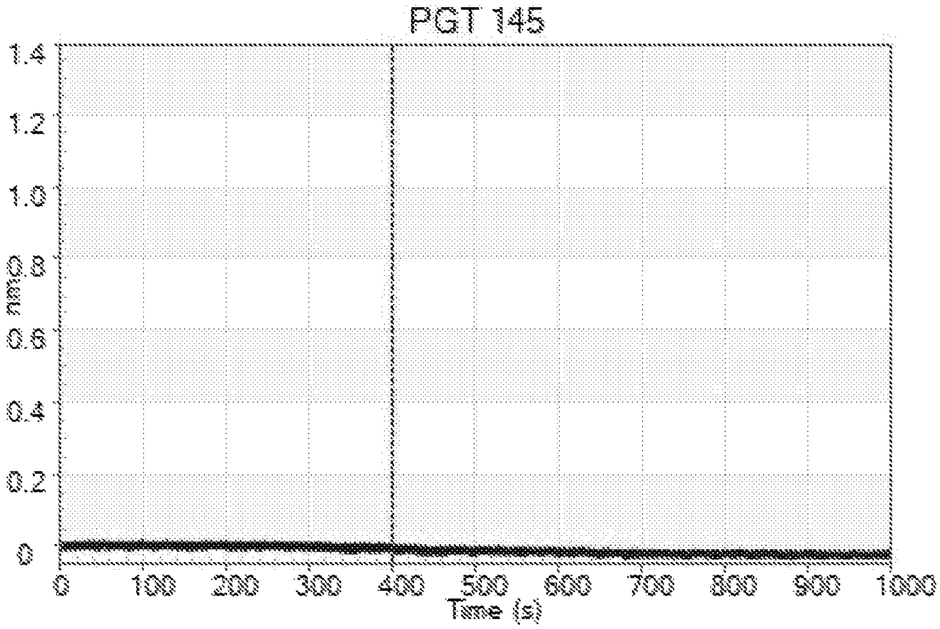
Figure 79I:
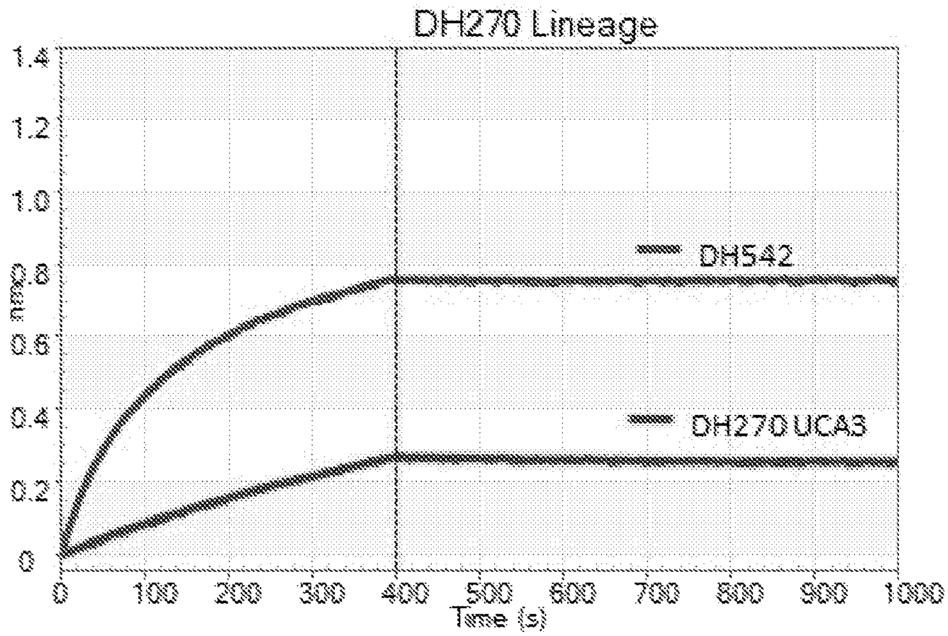
Figure 79J:
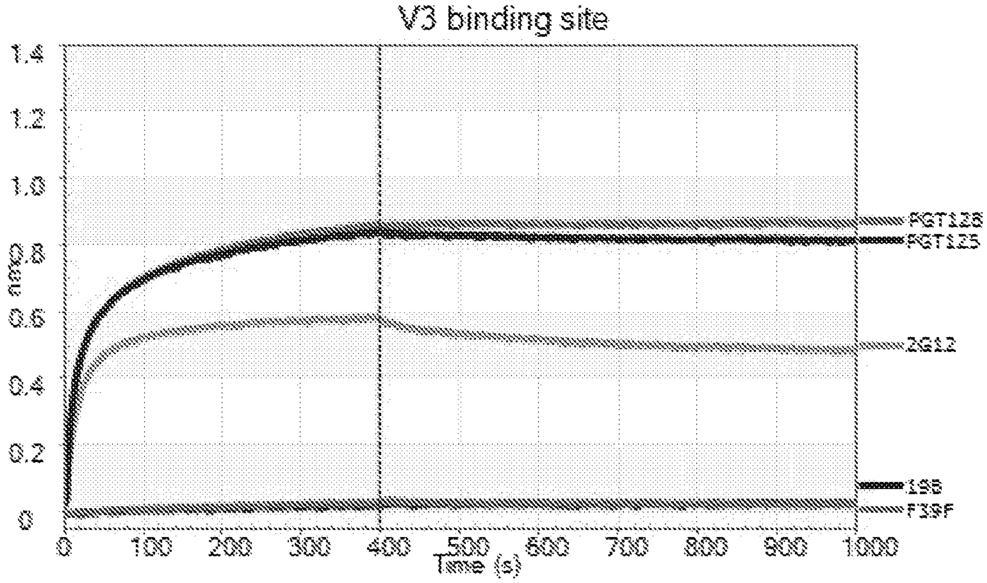
Figure 79K:
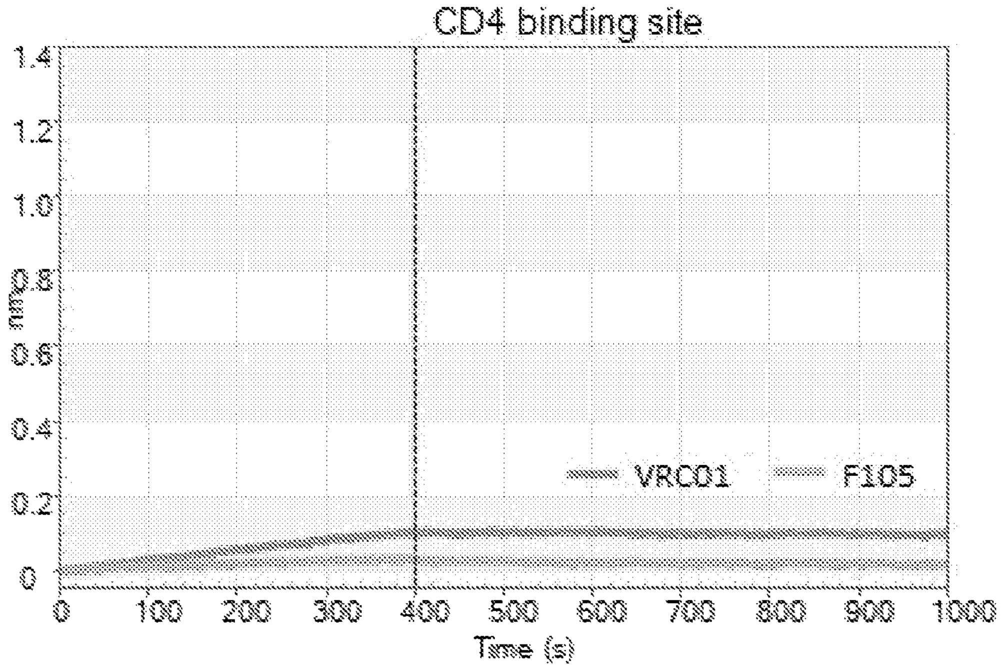
Figure 79L:
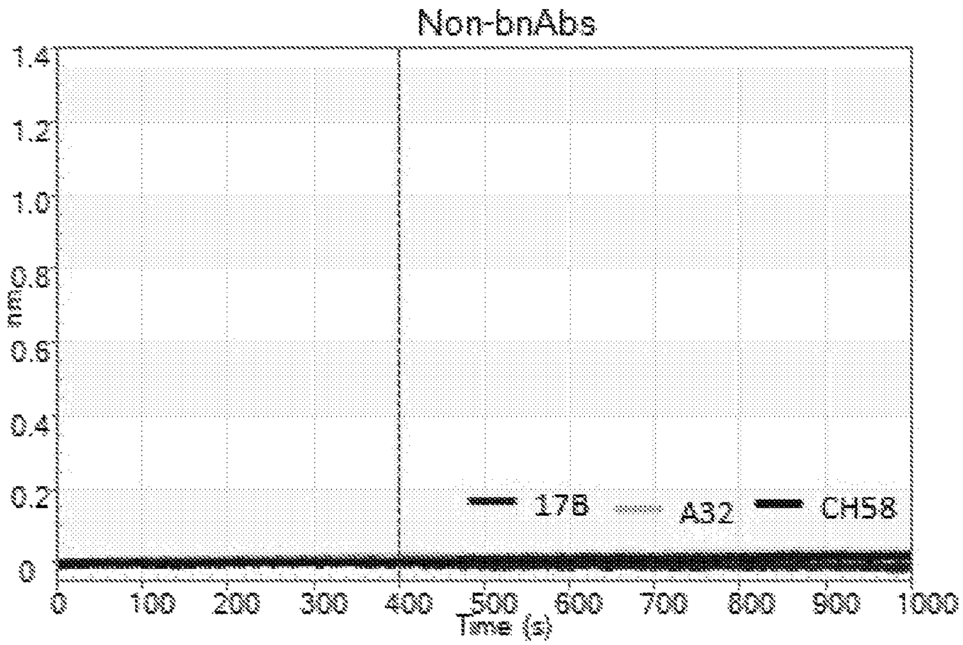

FIG. 73 shows DH270 UCA knock-in sera (see FIG. 65) block V3-glycan bnAb binding to gp120.

FIG. 74A-D show neutralization data from non-human primate study NHP-144. Arrows indicate immunizations at weeks 0, 4, 10, 16, 22. Samples tested for neutralization at weeks 0, 12, 18 or 24.

FIGS. 75A and 75B show the V1V2 loop sequence alignments show there are two glycosylation sites within the 10.17 V1 loop. The precise asparagines that are mutated in the 10.17DT Env design are underlined. The sequence for 10.17 is shown in relation to V1V2 loops of other viruses since V1 V2 amino acid numbering can vary depending on the alignment software, thus this alignment shows the exact position of each of the asparagines. Con-S V1 length is 22 aa. JRFL V1 length is 25aa. T250-4 V1 length is 22. CH0848.D0949.10.17 V1 length is 17aa. FIG. 75A discloses SEQ ID NOS 559-563, respectively, in order of appearance. FIG. 75B discloses SEQ ID NOS 564-568, 562 and 569, respectively, in order of appearance.

FIG. 76A-D shows binding data for a trimer comprising CH848.3.D0949.10.17CHIM.6R.SOSIP.664v4.1 degly3 produced in 293F cells. BLI sensor tips were coated with different bnAb precursors. Two DH270 UCA precursors were inferred (See e.g. FIG. 21) and binding to CH0848 Envelope in solution was examined with BLI. Both DH270 UCAs bound to the Env. DH270 UCA3 bound at a higher magnitude and had a low dissociation rate so once it is bound it remains engaged with Env. V3 glycan bnAb precursors PGT121 and PGT128 did not bind. BnAb precursors to bnAb epitopes with the CD4bs, V1V2 glycan did not bind to this trimer.

FIG. 77A-L shows sequences of various envelopes described in Table 4. FIG. 77A shows the sequence of HV1301331_degly3 with N138, N133, and N301 glycans removed. These glycans were believed to prevent DH270 mAb binding by blocking access to HIV peptide binding. FIG. 77B shows the sequence of HV1301331_N138T. This Env has a single V1 glycan removed. This Env would be used to sequentially add back glycans in the V1 loop to select antibodies capable of tolerating N301 and N133 glycans but not N138T. This Env could be used in a sequential Env vaccine where glycans are removed and added back sequentially. FIG. 77C shows the sequence of HV1301345_D368R. This Env has D368R mutation to reduce CD4 binding. CD4 binding could disrupt Env conformation in vivo. FIG. 77D shows the sequence of HV1301331_N133DN138T_c-SORTA. This tagged Env that can be ligated to particles by sortase A enzyme. FIG. 77E shows the sequence of HV1301522. This ferritin particle has a V1 glycan mutant Env attached as a fusion protein. FIG. 77F shows the sequence of HV1301345_N133D_N138T_cSORTA. This tagged Env can be ligated to particles by sortase A enzyme reactions in vitro. FIG. 77G shows the sequence of HV1301581, a full length gp160 HIV Env with V1 glycans removed to engender DH270 UCA binding. FIG. 77H shows the sequence of HV1301345_TFV1loop with the 10.17 Env with a long V1 loop that was transplanted from the TF virus sequence. This can be used to select for antibodies capable of accommodating a long V1 loop. FIG. 77I shows the sequence of HV1301345_N133D_N138T which is a stabilized trimer with V1 glycans removed to facilitate DH270 UCA binding. FIG. 77J shows the sequence of HV1301262 (has avi tag), a non-chimeric Env. FIG. 77K shows the sequence of HV1301263 (has avi tag), a chimeric DS Env without V1 glycan mutated. FIG. 77L shows the sequence of HV1301264 (has avi tag), a non-chimeric DS stabilized CH0848 trimer. FIGS. 77A-L disclose SEQ ID NOS 570-577, 551 and 578-580, respectively, in order of appearance.

FIG. 78A-B shows annotated sequences of CH848.3.D0949.10.17.6R.SOSIP.664 envelope and CH848.3.D0949.10.17 SOSIPv5.2.8. FIG. 78A shows the annotated sequence of CH848.3.D0949.10.17.6R.SOSIP.664. FIG. 78A discloses SEQ ID NO: 578. FIG. 78B shows the annotated sequence of CH848.3.D0949.10.17 SOSIPv5.2.8. FIG. 78B discloses SEQ ID NO: 581.

Figure 80:
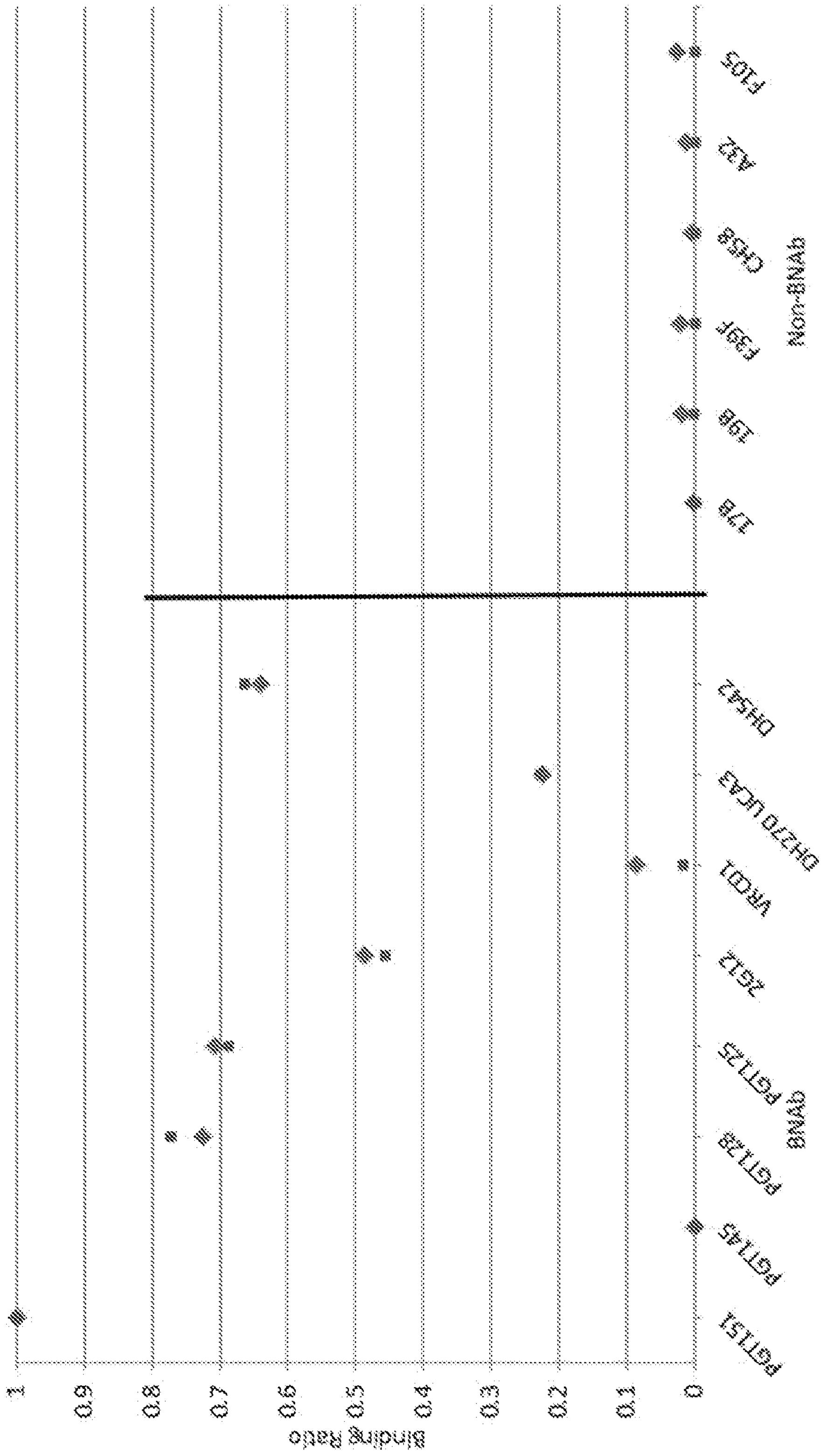

FIG. 79A-79L shows binding data for a trimer comprising CH848.3.D0949.10.17chim.6R.DS.SOSIP.664_N133D_N138T produced in 293F cells. BLI sensor tips were coated with different bnAb as indicated in the various panels. Binding was determined in the absence (79G-L) and presence (79A-79F) of 10 um of Temsavir (BMS-626529). Vertical dotted line indicates response at the end of association FIG. 80 shows a summary of binding data (from FIGS. 79A-79L) for a trimer comprising CH848.3.D0949.10.17chim.6R.DS.SOSIP.664_N133D_N138T produced in 293F cells. Figure shows binding Ratio Relative to PGT151. Diamonds show antibody trimer binding without BMS-626529 and squares show trimer binding in the presence of BMS-626529.

Figure 81:
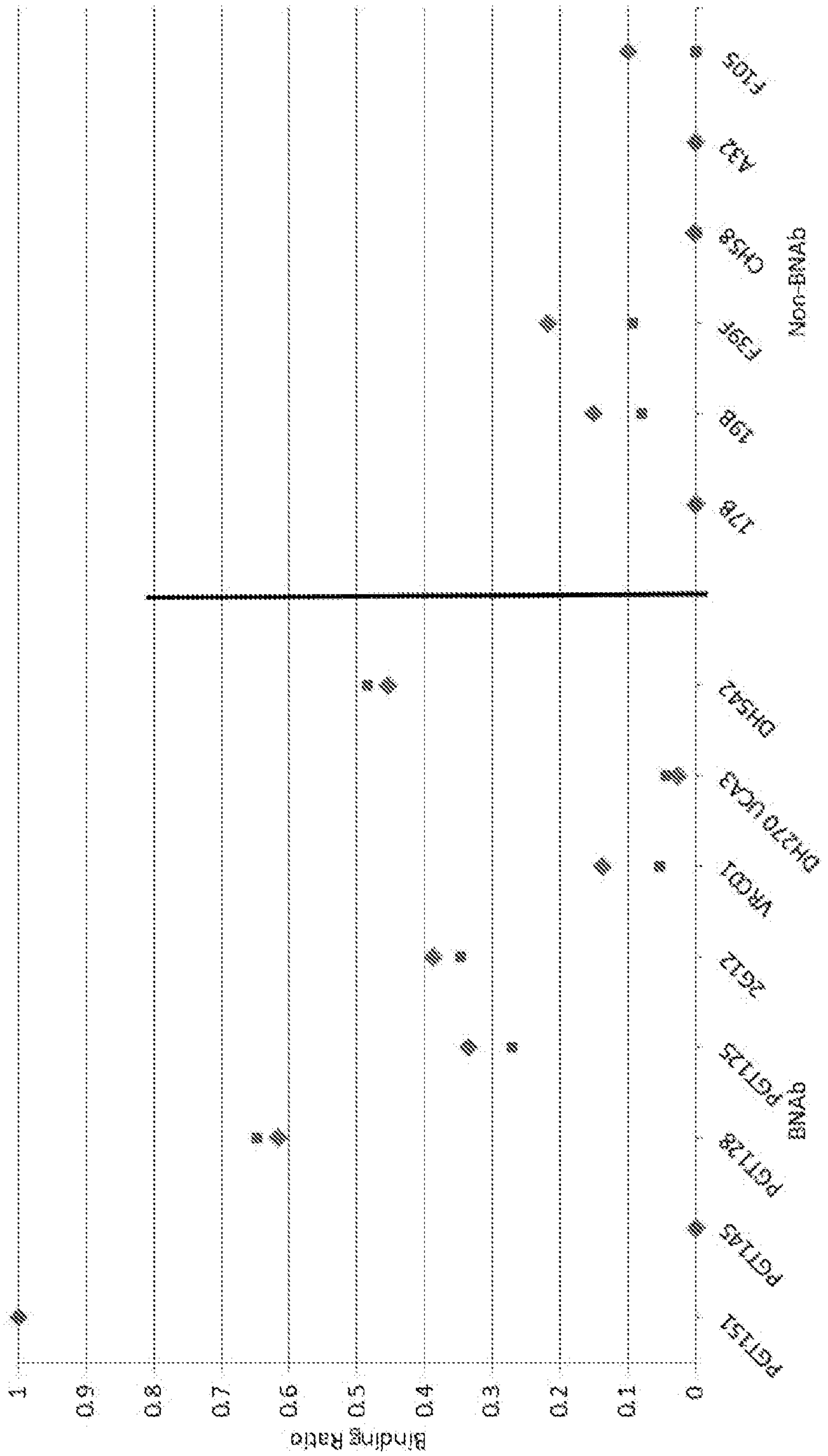

FIG. 81 shows a summary of BLI binding data for a trimer comprising CH848.3.D0949.10.17.chim.6R.DS.SOSIP.664_N301A produced in 293F cells. Figure shows binding Ratio Relative to PGT151. Diamonds show antibody trimer binding without BMS-626529 and squares show trimer binding in the presence of BMS-626529.

DETAILED DESCRIPTION

The third variable region, V3, of the envelope glycoprotein, gp120 of HIV-1 is a target for virus broad neutralizing antibodies. Several V3 glycan dependent broad neutralizing antibodies (bnAbs) have been isolated that neutralize diverse strains of difficult to neutralize viruses. A questions remains as to what form of Env could bind and initiate V3-glycan bnAb lineages. Soluble Env gp120 or cell surface Env trimers do not bind V3-glycan bnAb UCAs (20) (See Example 1). In some aspects the invention provides that the $Man_9$-V3glycopeptide (Example 2) as well as its aglycone (Example 2) form binds the UCA of the DH270V3-glycan bnAb lineage. Moreover, $Man_9$-V3/aglycone binds to the UCA of gp140-induced V3-glycan neutralizing mAb, DH501. With affinity maturation in both the DH270 bnAb and the DH501 lineages, binding to the aglycone-V3 diminished and binding to $Man_9$-V3 was dramatically enhanced. These observations raise the hypothesis that initiating immunogens for V3-glycan lineages may be denatured or Env fragments (Example 1 Bonsignori, M. et al. submitted).

The invention provides various methods to choose a subset of viral variants, including but not limited to envelopes, to investigate the role of antigenic diversity in serial samples. In other aspects, the invention provides compositions comprising viral variants, for example but not limited to envelopes, selected based on various criteria as described herein to be used as immunogens. In some embodiments, the immunogens are selected based on the envelope and/or peptide binding to the UCA, and/or intermediate antibodies. In some embodiments, the immunogens are selected based on UCA and/or intermediate antibodies neutralizing properties against viruses. In some embodiments the immunogens are selected based on their chronological appearance and/or sequence diversity during infection.

In other aspects, the invention provides immunization strategies using the selections of immunogens to induce cross-reactive neutralizing antibodies.

In certain aspects the invention provides an HIV-1 envelope sequence comprising non-glycosylatable amino acids in the V1 loop, at positions corresponding to N133 and/or N138 in the CH848.3.D0949.10.17 envelope sequence, wherein the envelope protomer sequence is based on the amino acid sequence of CH848.3.D0949.10.17 envelope; comprises amino acids from the CH848.3.D0949.10.17 envelope sequence, consists essentially of amino acids from CH848.3.D0949.10.17 envelope sequence and wherein the protomer is deglycosylated in the V1 loop (partially or completely in the V1 loop). In some embodiments, a deglycosylated envelope consists essentially of amino acids from CH848.3.D0949.10.17 envelope sequence when the deglycosylated envelopes has all amino acids from CH848.3.D0949.10.17 envelope sequence except for the amino acids at positions N133 and/or N138. In some embodiments, it further comprises amino acid changes for trimer formation.

Using sequence alignment algorithms, a skilled artisan can readily determine whether a V1 loop deglycosylated envelope is based on CH848.3.D0949.10.17 envelope sequence.

Comparing the sequences of envelopes, a skilled artisan can readily determine sequence identity, compare sequence length and determine the % sequence identity and/or changes, including % sequence identity and/or changes in the sequences, as well as the specific positions and types of substitutions which can be tolerated while the V1 loop deglycosylated envelope sequence is based on CH848.3.D0949.10.17.

Various algorithms for sequence alignment are known in the art. The similarity between amino acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs or variants of a polypeptide will possess a relatively high degree of sequence identity when aligned using standard methods.

Methods of alignment of sequences for comparison are well known in the art. Various programs and alignment algorithms are described in: Smith and Waterman, Adv. Appl. Math. 2:482, 1981; Needleman and Wunsch, J. Mol. Biol. 48:443, 1970; Pearson and Lipman, Proc. Natl. Acad. Sci. U.S.A. 85:2444, 1988; Higgins and Sharp, Gene 73:237, 1988; Higgins and Sharp, CABIOS 5:151, 1989; Corpet et al., Nucleic Acids Research 16:10881, 1988; and Pearson and Lipman, Proc. Natl. Acad. Sci. U.S.A. 85:2444, 1988. Altschul et al., Nature Genet. 6:119, 1994, presents a detailed consideration of sequence alignment methods and homology calculations.

The NCBI Basic Local Alignment Search Tool (BLAST) (Altschul et al., J. Mol. Biol. 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

In some embodiments a deglycosylated envelope is based on CH848.3.D0949.10.17 envelope if it is characterized by possession of at least about 65%, 70%, 75%, for example at least about 80%, 85%, 90%, 91%, 92%, 93%, 94%, 95%, 96%, 97%, 98% or 99% sequence identity counted over the full length alignment with the amino acid sequence of interest. When less than the entire sequence is being compared for sequence identity, a deglycosylated envelope could have at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

In some embodiments a deglycosylated envelope is based on CH848.3.D0949.10.17 envelope if it is characterized as having 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75.

In certain embodiments the envelope comprises amino acids substitutions within the CH848.3.D0949.10.17 sequence such that the envelope promoter forms a trimer. Any suitable envelope design or form is contemplated, so long as the envelope is based on CH848.3.D0949.10.17 sequence and the V1 loop is deglycosylated. In some embodiments short V1 loops of various length could be incorporated.

The invention provides amino acid or nucleic acids sequences encoding such deglycosylated proteins. Provided are also nucleic acids, including modified mRNAs which are stable and could be used as immunogens. Provided also are nucleic acids optionally designed as vectors, for example for recombinant expression and/or stable integration, e.g. but not limited, gp160 DNA encoding trimer for stable expression, or VLP incorporation.

In certain embodiments, the deglycosylated envelope is designed as a chimeric trimer chimeric (e.g incorporates amino acids and/or portions of envelope BG505). In certain embodiments, the deglycosylated envelopes are not chimeric, i.e. based on the sequence of envelope CH848.3.D0949.10.17 and comprising amino acids which help trimer formation. In certain embodiments, the envelope is designed as any suitable trimer, such as but not limited to various SOSIP designs, UFO trimers, or any other trimers. In certain embodiments, the envelopes of the invention comprising deglycosylated V1 positions binds and/or neutralizes DH270UCA3 and/or DH270UCA4. The envelope protomer, wherein the envelope is gp120, gp140, gp145, gp150 or gp160.

As Example 2 shows that a synthetic homogeneous $Man_9$-V3 glycopeptide mimics a HIV-1 Env V3-glycan bnAb epitope. Man9-V3 recognition by V3-glycan memory B cell and UCA BCR suggest that a minimal V3-glycan epitope construct may be a candidate for the induction of V3-glycan bnAb lineages. In HIV-1 infection, the DH270 V3-glycan bnAb lineage developed over ~4 years (Bonsignori, M et al. submitted), and V3-glycan-targeted antibodies took 4 years to develop in macaques repetitively immunized with Env gp140 (Saunders, K et al. submitted). Thus, while whole Env monomers or trimers do not bind to V3-glycan bnAb UCAs, the V3-glycopeptide does bind UCAs, suggesting that minimal Env epitopes may accelerate induction of V3-glycan bnAb B cell lineages.

Described herein are both the design and selections of immunogens to elicit neutralizing antibodies directed toward the V3 glycan epitope defined by V3 binding antibodies. Minimal V3 region glycopeptides bearing two glycans of appropriate structure can mimic the antigenic nature of this epitope, and can provide an effective platform for immunogen development. This concept—based on the "two glycans and a strand" paradigm of recognition suggested by x-ray analysis.sup.6—has been successfully applied to the V1V2 region anti-glycan BnAb site. Given the likely rarity of naive B cells relevant to BnAb ontogeny in the immune repertoire, preferred immunogens include those that exclude potentially interfering immunodominant epitopes. These immunogens can be evaluated not only based on their affinities for mature BnAbs, but also their germline precursors.

In certain embodiment, the invention provides a composition comprising any one of the inventive peptides, wherein the composition comprises purified homogenously glycosylated peptides. In certain embodiments, about 70%, 75%, 80%, 85%, 90%, 95%, 99%, or 99.9% of the peptides in the composition are homogenously glycosylated peptides. In certain embodiments, 70%, 75%, 80%, 85%, 90%, 95%, 99%, or 99.9% of the peptides in the composition are homogenously glycosylated peptides. In certain embodiments, 70%-75%, 75.1%-80%, 80.1%-85%, 85.1%-90%, 90.1%-95%, 95.1%-99%, 96%-99%, 97%-99%, 98%-99% or 99.9% of the peptides in the composition are homogenously glycosylated peptides. In certain embodiment, the glycosylation pattern is homogenous on all V3 peptides in the composition. In certain embodiment, the glycosylation pattern is substantially identical on all V3 peptides in the composition.

Various methods of determining the glycosylation pattern on a peptide are known in the art. In certain embodiments, glycosylation pattern on the peptides and % homogeneity can be determined by Liquid chromatography—mass spectrometry (LC-MS, or alternatively HPLC-MS).

As indicated in the Examples that follow, V3 glycopeptides can be synthesized with well-defined glycans at N332 and N301 using clade B and clade C sequences (derived from Envs with known antigenicity toward V3 anti-glycan BnAbs). Variations of the peptide framework include full length vs. truncated V3 loops, as well as linear vs. constrained cyclic forms (via disulfide bond formation). Antigenicity testing provides the data needed to determine the peptide design motif that is optimal for binding to HIV-1 Env anti-glycan BnAbs. Using the best peptide "scaffold", derivatives can be synthesized bearing different glycans at N332 and N301 and the determination made as to the optimal carbohydrate design for anti-glycan BnAb binding. The constructs that exhibit the highest affinity for V3-directed anti-glycan BnAbs and their UCAs can be synthesized on larger scale and subjected to trials e.g., in non-human primates—immunogenicity can be evaluated for constructs both with and without conjugation to carrier protein.

The present invention thus relates, at least in part, to immunogens that focus the immune response to the V3 glycan epitope on gp120 that lead to BnAbs and away from epitopes that lead to non-neutralizing antibodies. Central to the present design strategy is making the immunogen as minimal in size as possible so as not to introduce diverting, non-neutralizing epitopes. Non-limiting embodiments of immunogens are described in the Examples below.

The immunogens can be formulated with appropriate carriers using standard techniques to yield compositions suitable for administration. The compositions can include an adjuvant, such as, for example, alum, poly IC, poly IC/LC, MF-59 or other squalene-based adjuvant, AS01B or other liposomal based adjuvant suitable for protein immunization. Suitable vaccine strategies include, e.g., those described, for in the Examples that follow.

Nucleic acid sequences (e.g., DNA sequences) encoding the immunogens can also be administered to a subject (e.g., a human) under conditions such that the immunogen is expressed in vivo and BNAbs are produced. The DNA can be present as naked DNA with a potent promoter such as the CMV promoter as used in the pCMVr plasmid (Churchyard et al, PLoS One 6:e21225 (2011)) or as an insert in a vector, such as a rAdenoviral (Barouch, et al. Nature Med. 16: 319-23 (2010), recombinant mycobacterial (i.e., BCG or *M smegmatis*) (Yu et al. Clinical Vaccine Immunol. 14: 886-093 (2007); ibid 13: 1204-11 (2006), or recombinant vaccinia type of vector (Santra S. Nature Med. 16: 324-8 (2010)).

Immunogens of the invention, and nucleic acids (e.g., DNAs) encoding same, are suitable for use in generating an immune response (e.g., BNAbs) in a patient (e.g., a human patient) to HIV-1. The V3 N301, N332 peptide glycan can optimally be administered as a peptide-glycan formulated in a squalene based adjuvant such as MF59, or GLA-SE (Alving et al, Current Opinion in Immunology 24:310 (2012)). The mode of administration of the immunogen, or encoding sequence, can vary with the particular immunogen, the patient and the effect sought, similarly, the dose administered. Typically, the administration route is intramuscular or subcutaneous injection (intravenous and intraperitoneal can also be used). Additionally, the formulations can be administered via the intranasal route, or intrarectally or vaginally as a suppository-like vehicle. Optimum dosing regimens can be readily determined by one skilled in the art. The immunogens (and nucleic acids encoding same) are preferred for use prophylactically, however, their administration to infected individuals may reduce viral load.

The present invention includes the specific protein immunogens disclosed herein and nucleic acids comprising nucleotide sequences encoding same. The proteins can be expressed, for example, in 293T cells, 293F cells or CHO cells (Liao et al, Virology 353:268-82 (2006))

Peptides

The polypeptides of the present invention may be fused to or chemically linked with an appropriate carrier molecule, such as tetanus toxin, MLv gp70, cholera toxin, keyhole limpet haemocyanin or gp120. Alternatively, the polypeptides of the present invention may be inserted by genetic engineering techniques into permissible exposed loops of antigenic proteins.

Versions of the constructs that are conjugated to carrier protein will be produced for the purposes of comparison. Carrier proteins used in currently licensed vaccines include tetanus toxoid (TT), diphtheria toxoid (DT), CRM.sub. 197 (cross-reactive material of diphtheria toxin. sub.197), *N. meningitidis* outer membrane protein (OMP), and *H. influenzae* protein D.sup.64 For the initial studies, CRM.sub.197, a non-toxic mutant (G52.fwdarw.D) of diphtheria toxin, will be selected which, unlike TT and DT, does not require chemical detoxification with formaldehyde. Thus, it is a well-defined, homogeneous 63 kD protein with a complete set of free, surface-exposed lysine chains (39 total), devoid of cross-linking, which are available for conjugation with potential haptens. Keyhole limpet hemocyanin (KLH) would be a potential alternative.

Alternatively the polypeptides of the present invention may be linked to amino acids derived from a T-helper epitope to enhance their immunogenicity.

A T-helper epitope is a peptide capable of activating a T helper cell. The T-helper epitope may be a human immunodeficiency virus (HIV) T helper epitope e.g. from the C4 domain of HIV gp120. According to one embodiment, the T helper epitope comprises about 16 consecutive residues from the C4 domain (about residues 421 to 436). According to another embodiment, the T-helper sequence is a variation of the above.

Contemplated T helper epitopes from the C4 domain are described in U.S. Pat. Appl. No. 20030147888, incorporated herein by reference. Other T helper determinants from HIV or from non-HIV proteins can also be used. For example, a further T helper epitope suitable for use in the invention is from HIV gag (e.g., residues 262-278). One such sequence is designated GTH1. Variants of this sequence can also be used.

Another contemplated T helper epitope is derived from murine HSP60 458-474.

In some embodiments, a carbohydrate such as the outer membrane protein of pneumococcus, or another carbohydrate or protein with immunogenic, T helper activity can be used.

The T-helper epitope amino acids may be linked to the V3 portion of the peptides of the present invention using any method known in the art so long as it does not decrease the immunogenic and antigenic properties of the peptide.

The amino acids of the V3 domain of gp120 are preferably linked C terminal to the amino acids of the T-helper epitope.

According to one embodiment, the V3 portion of the polypeptide is linked to the T helper epitope via a covalent bond (e.g. a peptide bond). According to another embodiment, the V3 portion of the polypeptide is linked to the T helper epitope via a non-covalent linker. The linkage may be direct or via bonding to an intervening linker element, such as a linker peptide or other chemical moiety, such as an organic polymer.

Any suitable method for conjugating the V3 portion with the T helper epitope portion are known in the art.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the polypeptides of the present invention may also include one or more modified amino acids or one or more non-amino acid moieties (e.g. lipids, complex carbohydrates etc.). In some embodiments, these non-amino acid moieties are used to multimerize the peptides of the invention.

Amino acids incorporated in the peptides of the invention could include the 20 naturally occurring amino acids, D- and L-amino acids (stereoisomers); those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine.

Sequences/Clones

Described herein are nucleic and amino acids sequences of HIV-1 envelopes. The sequences for use as immunogens are in any suitable form. In certain embodiments, the described HIV-1 envelope sequences are gp160s. In certain embodiments, the described HIV-1 envelope sequences are gp120s. Other sequences, for example but not limited to stable SOSIP trimer designs, gp145s, gp140s, both cleaved and uncleaved, gp140 Envs with the deletion of the cleavage (C) site, fusion (F) and immunodominant (I) region in gp41—named as gp140ΔCFI (gp140CFI), gp140 Envs with the deletion of only the cleavage (C) site and fusion (F) domain—named as gp140ΔCF (gp140CF), gp140 Envs with the deletion of only the cleavage (C)—named gp140ΔC (gp140C) (See e.g. Liao et al. Virology 2006, 353, 268-282), gp150s, gp41s, which are readily derived from the nucleic acid and amino acid gp160 sequences. In certain embodiments the nucleic acid sequences are codon optimized for optimal expression in a host cell, for example a mammalian cell, a rBCG cell or any other suitable expression system.

An HIV-1 envelope has various structurally defined fragments/forms: gp160; gp140—including cleaved gp140 and uncleaved gp140 (gp140C), gp140CF, or gp140CFI; gp120 and gp41. A skilled artisan appreciates that these fragments/forms are defined not necessarily by their crystal structure, but by their design and bounds within the full length of the gp160 envelope. While the specific consecutive amino acid sequences of envelopes from different strains are different, the bounds and design of these forms are well known and characterized in the art.

For example, it is well known in the art that during its transport to the cell surface, the gp160 polypeptide is processed and proteolytically cleaved to gp120 and gp41 proteins. Cleavages of gp160 to gp120 and gp41 occurs at a conserved cleavage site “REKR” (SEQ ID NO: 37). See Chakrabarti et al. Journal of Virology vol. 76, pp. 5357-5368 (2002) see for example FIG. 1, and Second paragraph in the Introduction on p. 5357; Binley et al. Journal of Virology vol. 76, pp. 2606-2616 (2002) for example at Abstract; Gao et al. Journal of Virology vol. 79, pp. 1154-1163 (2005); Liao et al. Virology vol. 353(2): 268-282 (2006).

The role of the furin cleavage site was well understood both in terms of improving cleave efficiency, see Binley et al. supra, and eliminating cleavage, see Bosch and Pawlita, Virology 64 (5):2337-2344 (1990); Guo et al. Virology 174: 217-224 (1990); McCune et al. Cell 53:55-67 (1988); Liao et al. J Virol. April; 87(8):4185-201 (2013).

Likewise, the design of gp140 envelope forms is also well known in the art, along with the various specific changes which give rise to the gp140C (uncleaved envelope), gp140CF and gp140CFI forms. Envelope gp140 forms are designed by introducing a stop codon within the gp41 sequence. See Chakrabarti et al. at FIG. 1.

Envelope gp140C refers to a gp140 HIV-1 envelope design with a functional deletion of the cleavage (C) site, so that the gp140 envelope is not cleaved at the furin cleavage site. The specification describes cleaved and uncleaved forms, and various furin cleavage site modifications that prevent envelope cleavage are known in the art. In some embodiments of the gp140C form, two of the R residues in and near the furin cleavage site are changed to E, e.g., RRVVEREKR (SEQ ID NO: 38) is changed to ERVVEREKE (SEQ ID NO: 39), and is one example of an uncleaved gp140 form. Another example is the gp140C form which has the REKR site (SEQ ID NO: 37) changed to SEKS (SEQ ID NO: 40). See supra for references.

Envelope gp140CF refers to a gp140 HIV-1 envelope design with a deletion of the cleavage (C) site and fusion (F) region. Envelope gp140CFI refers to a gp140 HIV-1 envelope design with a deletion of the cleavage (C) site, fusion (F) and immunodominant (I) region in gp41. See Chakrabarti et al. Journal of Virology vol. 76, pp. 5357-5368 (2002) see for example FIG. 1, and Second paragraph in the Introduction on p. 5357; Binley et al. Journal of Virology vol. 76, pp. 2606-2616 (2002) for example at Abstract; Gao et al. Journal of Virology vol. 79, pp. 1154-1163 (2005); Liao et al. Virology vol. 353(2): 268-282 (2006).

In certain embodiments, the envelope design in accordance with the present invention involves deletion of residues (e.g., 5-11, 5, 6, 7, 8, 9, 10, or 11 amino acids) at the N-terminus. For delta N-terminal design, amino acid residues ranging from 4 residues or even fewer to 14 residues or even more are deleted. These residues are between the maturation (signal peptide, usually ending with CXX, X can be any amino acid) and “VPVXXXX . . . ” In one embodiments, CH0848.3.D0949.10.17 Delta11 gp120 is shown as an example in FIG. 3A. In certain embodiments, the invention relates generally to an immunogen, gp160, gp120 or gp140, without an N-terminal Herpes Simplex gD tag substituted for amino acids of the N-terminus of gp120, with an HIV leader sequence (or other leader sequence), and without the original about 4 to about 25, for example 4, 5, 6, 7, 8, 9, 10, 11, 12, 13, 14, 15, 16, 17, 18, 19, 20, 21, 22, 23, 24, 25 amino acids of the N-terminus of the envelope (e.g. gp120). See WO2013/006688, e.g. at pages 10-12, the contents of which publication is hereby incorporated by reference in its entirety.

The general strategy of deletion of N-terminal amino acids of envelopes results in proteins, for example gp120s, expressed in mammalian cells that are primarily monomeric, as opposed to dimeric, and, therefore, solves the production and scalability problem of commercial gp120 Env vaccine production. In other embodiments, the amino acid deletions at the N-terminus result in increased immunogenicity of the envelopes.

In certain embodiments, the invention provides envelope sequences, amino acid sequences and the corresponding nucleic acids, and in which the V3 loop is substituted with the following V3 loop sequence TRPNNNTRK-SIRIGPGQTFY ATGDIIGNIRQAH (SEQ ID NO: 41). This substitution of the V3 loop reduced product cleavage and improves protein yield during recombinant protein production in CHO cells.

Soluble trimers comprising CH848 envelopes are contemplated by the invention and such trimer are contemplated for use in the methods of the invention. Various ways to form soluble envelope trimers are known in the art. See e.g. US Pub. 20100041875; US Pub 20110076298; US Pub. 20110250220; WO2016/037154, de Taeye et al. Cell. 2015 Dec. 17; 163(7): 1702-15. doi: 10.1016/j.cell.2015.11.056; Kwon et al. Nat Struct Mol Biol. 2015 July; 22(7):522-31. doi: 10.1038/nsmb.3051. Epub 2015 Jun. 22; Sharma et al. Cell Rep. 2015 Apr. 28; 11(4):539-50. doi: 10.1016/j.celrep.2015.03.047. Epub 2015 Apr. 16, Kong et al. in Nat Commun. 2016 Jun. 28; 7:12040. doi: 10.1038/ncomms12040, all of these publications are incorporated by reference in their entirety.

The invention provides new chimeric designs, for example but not limited to CH848.3.D0949.10.17CHIM.6R. SOSIP. 664V4.1 (FIG. 41C). Non-limiting examples of trimer sequence designs are shown in FIGS. 39A-B, 40A-C, and 41A-C, Table 1, Table 3, and Table 4. In some embodiments, the HIV-1 envelope trimer complex incorporated some aspects of the SOSIP HIV-1 trimer design.

Properties of the trimer complexes of the invention can be determined by any suitable assay used to characterize trimer envelope complexes. Antigenicity of the trimers, for example binding to HIV-1 antibodies, including but not limited to antibodies described in the invention, conformational state of the trimers, i.e., "open" or "closed", immunogenicity can be determined by any suitable assay. For discussion on open versus closed envelope confirmation see de Taeye et al. Cell. 2015 Dec. 17; 163(7):1702-15; Munro et a; Science 7 Nov. 2014: Vol. 346, Issue 6210, pp. 759-763, DOI: 10.1126/science.1254426; Guttman et al., Nature Communications 6, Article number: 6144 doi:10.1038/ncomms7144.

In certain aspects, the invention provides composition and methods which use a selection of Envs, as gp120s, gp 140s cleaved and uncleaved, gp145s, gp150s and gp160s, as proteins, as monomers or trimers, as DNAs, as RNAs, or any combination thereof, administered as primes and boosts to elicit immune response. Envelopes as proteins could be co-administered with nucleic acid vectors containing Envs to amplify antibody induction. In certain embodiments, the compositions and methods include any immunogenic HIV-1 sequences to give the best coverage for T cell help and cytotoxic T cell induction. In certain embodiments, the compositions and methods include mosaic and/or consensus HIV-1 genes to give the best coverage for T cell help and cytotoxic T cell induction. In certain embodiments, the compositions and methods include mosaic group M and/or consensus genes to give the best coverage for T cell help and cytotoxic T cell induction. In some embodiments, the mosaic genes are any suitable gene from the HIV-1 genome. In some embodiments, the mosaic genes are Env genes, Gag genes, Pol genes, Nef genes, or any combination thereof. See e.g. U.S. Pat. No. 7,951,377. In some embodiments the mosaic genes are bivalent mosaics. In some embodiments the mosaic genes are trivalent. In some embodiments, the mosaic genes are administered in a suitable vector with each immunization with Env gene inserts in a suitable vector and/or as a protein. In some embodiments, the mosaic genes, for example as bivalent mosaic Gag group M consensus genes, are administered in a suitable vector, for example but not limited to HSV2, would be administered with each immunization with Env gene inserts in a suitable vector, for example but not limited to HSV-2.

In certain aspects the invention provides compositions and methods of Env genetic immunization either alone or with Env proteins to recreate the swarms of evolved viruses that have led to bnAb induction. Nucleotide-based vaccines offer a flexible vector format to immunize against virtually any protein antigen. Currently, two types of genetic vaccination are available for testing—DNAs and mRNAs.

In certain aspects the invention contemplates using immunogenic compositions wherein immunogens are delivered as DNA. See Graham B S, Enama M E, Nason M C, Gordon I J, Peel S A, et al. (2013) DNA Vaccine Delivered by a Needle-Free Injection Device Improves Potency of Priming for Antibody and CD8+ T-Cell Responses after rAd5 Boost in a Randomized Clinical Trial. PLoS ONE 8(4): e59340, page 9. Various technologies for delivery of nucleic acids, as DNA and/or RNA, so as to elicit immune response, both T-cell and humoral responses, are known in the art and are under developments. In certain embodiments, DNA can be delivered as naked DNA. In certain embodiments, DNA is formulated for delivery by a gene gun. In certain embodiments, DNA is administered by electroporation, or by a needle-free injection technologies, for example but not limited to Biojector® device. In certain embodiments, the DNA is inserted in vectors. The DNA is delivered using a suitable vector for expression in mammalian cells. In certain embodiments the nucleic acids encoding the envelopes are optimized for expression. In certain embodiments DNA is optimized, e.g. codon optimized, for expression. In certain embodiments the nucleic acids are optimized for expression in vectors and/or in mammalian cells. In non-limiting embodiments these are bacterially derived vectors, adenovirus based vectors, rAdenovirus (e.g. Barouch D H, et al. Nature Med. 16: 319-23, 2010), recombinant mycobacteria (e.g. rBCG or *M smegmatis*) (Yu, J S et al. Clinical Vaccine Immunol. 14: 886-093, 2007; ibid 13: 1204-11, 2006), and recombinant vaccinia type of vectors (Santra S. Nature Med. 16: 324-8, 2010), for example but not limited to ALVAC, replicating (Kibler K V et al., PLoS One 6: e25674, 2011 Nov. 9.) and non-replicating (Perreau M et al. J. virology 85: 9854-62, 2011) NYVAC, modified vaccinia Ankara (MVA)), adeno-associated virus, Venezuelan equine encephalitis (VEE) replicons, Herpes Simplex Virus vectors, and other suitable vectors.

In certain aspects the invention contemplates using immunogenic compositions wherein immunogens are delivered as DNA or RNA in suitable formulations. Various technologies which contemplate using DNA or RNA, or may use complexes of nucleic acid molecules and other entities to be used in immunization. In certain embodiments, DNA or RNA is administered as nanoparticles consisting of low dose antigen-encoding DNA formulated with a block copolymer (amphiphilic block copolymer 704). See Cany et al., Journal of Hepatology 2011 vol. 54 j 115-121; Amaoty et al., Chapter 17 in Yves Bigot (ed.), Mobile Genetic Elements: Protocols and Genomic Applications, Methods in Molecular Biology, vol. 859, pp 293-305 (2012); Arnaoty et al. (2013) Mol Genet Genomics. 2013 August; 288(7-8): 347-63. Nanocarrier technologies called Nanotaxi® for immunogenic macromolecules (DNA, RNA, Protein) delivery are under development. See for example technologies developed by Incellart. In certain embodiments, the nucleic acids, for e.g. mRNAs encoding immunogens of the invention, are delivered by a lipid nanoparticle (LNP) technology. In non-limiting embodiments, the LNPs could comprise four different lipids that could self assemble to 80-100 nm size particles.

In certain aspects the invention contemplates using immunogenic compositions wherein immunogens are delivered as recombinant proteins. Various methods for production and purification of recombinant proteins suitable for use in immunization are known in the art. In certain embodiments recombinant proteins are produced in CHO cells.

The immunogenic envelopes can also be administered as a protein boost in combination with a variety of nucleic acid envelope primes (e.g., HIV-1 Envs delivered as DNA expressed in viral or bacterial vectors).

Dosing of proteins and nucleic acids can be readily determined by a skilled artisan. A single dose of nucleic acid can range from a few nanograms (ng) to a few micrograms (g) or milligram of a single immunogenic nucleic acid. Recombinant protein dose can range from a few μg micrograms to a few hundred micrograms, or milligrams of a single immunogenic polypeptide.

Administration: The compositions can be formulated with appropriate carriers using known techniques to yield compositions suitable for various routes of administration. In certain embodiments the compositions are delivered via intramascular (IM), via subcutaneous, via intravenous, via nasal, via mucosal routes, or any other suitable route of immunization.

The compositions can be formulated with appropriate carriers and adjuvants using techniques to yield compositions suitable for immunization. The compositions can include an adjuvant, such as, for example but not limited to, alum, poly IC, MF-59 or other squalene-based adjuvant, ASO1B, or other liposomal based adjuvant suitable for protein or nucleic acid immunization. In certain embodiments, the adjuvant is GSK AS01E adjuvant containing MPL and QS21. This adjuvant has been shown by GSK to be as potent as the similar adjuvant AS01B but to be less reactogenic using HBsAg as vaccine antigen [Leroux-Roels et al., IABS Conference, April 2013, 9]. In certain embodiments, TLR agonists are used as adjuvants. In other embodiment, adjuvants which break immune tolerance are included in the immunogenic compositions.

In certain embodiments, the compositions are formulated such that the immunoges are comprises in nanoparticles. In some embodiments, these are lipid nanoparticle immunogens. In some embodiments, these are liposomes comprising immunogens. In some embodiments these are lipid nanodiscs. The immunogens could be arranged as particulate, high-density array on liposomes or other particles, for example but not limited to nanoparticles. In non-limiting embodiment, the liposome comprises cholesterol, PC, PE, PA, or any combination thereof. See Alam et al. J Immunol. 2007 Apr. 1; 178(7):4424-35; Alam et al. J Virol. 2008 January; 82(1):115-25; Alam et al. Proc Natl Acad Sci USA. 2009 Dec. 1; 106(48):20234-9. doi: 10.1073/pnas.0908713106; Dennison et al. J Virol. 2009 October; 83(19):10211-23. doi: 10.1128/JVI.00571-09; Dennison et al. PLoS One. 2011; 6(11):e27824. doi: 10.1371/journal.pone. 0027824. In some embodiments, the lipid composition of lipid nanoparticle comprises cholesterol, POPC, sphingomyelin, or any combination thereof. In some embodiments, the lipids could comprise POPC, POPE, DMPA, cholesterol, or any combination thereof. In some embodiments, the ratio is POPC:POPE:DMPA:Cholesterol 45:25:20:1.33. In some embodiments, the protein to lipid ratio is about 1:3000. In some embodiments, the peptide to lipid ratio used provides 50-100 mer V3 peptide units per 100-200 nm lipid nanoparticle. In some embodiments the peptide:lipid ratio is 1:100. A skilled artisan can readily determine conditions and lipids to achieve different desired ratios.

In certain embodiments, the compositions and methods comprise any suitable agent or immune modulation which could modulate mechanisms of host immune tolerance and release of the induced antibodies. In non-limiting embodiments modulation includes PD-1 blockade; T regulatory cell depletion; anti-CD25 antibodies; CD40L hyperstimulation; anti-CTLA4 antibodies; soluble antigen administration, wherein the soluble antigen is designed such that the soluble agent eliminates B cells targeting dominant epitopes, or a combination thereof. In certain embodiments, an immunomodulatory agent is administered in at time and in an amount sufficient for transient modulation of the subject's immune response so as to induce an immune response which comprises broad neutralizing antibodies against HIV-1 envelope. Non-limiting examples of such agents is any one of the agents described herein: e.g. chloroquine (CQ), PTP1B Inhibitor—CAS 765317-72-4—Calbiochem or MSI 1436 clodronate or any other bisphosphonate; a Foxo1 inhibitor, e.g. 344355|Foxo1 Inhibitor, AS1842856—Calbiochem; Gleevac, anti-CD25 antibody, anti-CCR4 Ab, an agent which binds to a B cell receptor for a dominant HIV-1 envelope epitope, or any combination thereof. In non-limiting embodiments, the modulation includes administering an anti-CTLA4 antibody. Non-limiting examples are ipilimumab and tremelimumab. In certain embodiments, the methods comprise administering a second immunomodulatory agent, wherein the second and first immunomodulatory agents are different.

TABLE 1

Summary of some disclosure of proteins and sequences.

| | gp160 | gp120 delta11 | chim.6R.SOSIP.664 | chim.6R.DS.SOSIP.664 | CHIM.6R.SOSIP.664V4.1 | CHIM.6R.SOSIP.664V4.2 |
|---|---|---|---|---|---|---|
| CH848.0949.10.17 aa | | | | | FIG. 41A and 41C | FIG. 41A |
| One embodiment of a nucleic acid | | | | | FIG. 41B | FIG. 41B |

| | gp160 | gp120 delta11 | chim.6R.SOSIP.664 | chim.6R.DS.SOSIP.664 | 6R.SOSIP.664 | 6R.D5.SOSIP.664 |
|---|---|---|---|---|---|---|
| CH848.0949.10.17 aa | FIG. 39A | FIG. 39A | FIG. 39A | FIG. 39A | FIG. 39A | FIG. 39A |
| One embodiment of a nucleic acid | FIG. 39B | FIG. 39B | FIG. 39B | FIG. 39B | FIG. 39B | FIG. 39B |

TABLE 1-continued

Summary of some disclosure of proteins and sequences.

| | gp160 | gp120 delta11 | CHIM.6R.SOSIP.664 | CHIMDS.6R.SOSIP.664 | CHIM.6R.SOSIP.664V4.1 | CHIM.6R.SOSIP.664V4.2 |
|---|---|---|---|---|---|---|
| CH848.0836.10.31 aa One embodiment of a nucleic acid | FIG. 40A | FIG. 40A | FIG. 40A | FIG. 40A | FIG. 40A | FIG. 40A |
| CH848.0358.80.06 aa One embodiment of a nucleic acid | FIG. 40A | FIG. 40A | FIG. 40A | FIG. 40A | FIG. 40A | FIG. 40A |
| CH848.1432.5.41 aa One embodiment of a nucleic acid | FIG. 40A | FIG. 40A | FIG. 40A | FIG. 40A | FIG. 40A | FIG. 40A |
| CH848.0526.25.02 aa One embodiment of a nucleic acid | FIG. 40A | FIG. 40A | FIG. 40A | FIG. 40A | FIG. 40A | FIG. 40A |
| CH848.3.D0794.__ 5.41 aa One embodiment of a nucleic acid | FIG. 40A | FIG. 40A | FIG. 40A | FIG. 40A | FIG. 40A | FIG. 40A |
| CH848.0526.25.09 aa One embodiment of a nucleic acid | FIG. 40A | FIG. 40A | FIG. 40A | FIG. 40A | FIG. 40A | FIG. 40A |
| CH848.1120.10.21 aa One embodiment of a nucleic acid | FIG. 41A | FIG. 41A | FIG. 41A | FIG. 41A | FIG. 41A | FIG. 41A |
| CH848.1432.05.27 aa One embodiment of a nucleic acid | FIG. 41A | FIG. 41A | FIG. 41A | FIG. 41A | FIG. 41A | FIG. 41A |
| CH848.0949.10.18 aa One embodiment of a nucleic acid | FIG. 41A | FIG. 41A | FIG. 41A | FIG. 41A | FIG. 41A | FIG. 41A |
| CH848 T/F | FIG. 40C | | | | | |

It is readily understood that the envelope glycoproteins referenced in various examples and figures comprise a signal/leader sequence. It is well known in the art that HIV-1 envelope glycoprotein is a secretory protein with a signal or leader peptide sequence that is removed during processing and recombinant expression (without removal of the signal peptide, the protein is not secreted). See for example Li et al. Control of expression, glycosylation, and secretion of HIV-1 gp120 by homologous and heterologous signal sequences. Virology 204(1):266-78 (1994) ("Li et al. 1994"), at first paragraph, and Li et al. Effects of inefficient cleavage of the signal sequence of HIV-1 gp120 on its association with calnexin, folding, and intracellular transport. PNAS 93:9606-9611 (1996) ("Li et al. 1996"), at 9609. Any suitable signal sequence could be used. In some embodiments the leader sequence is the endogenous leader sequence. Most of the gp120 and gp160 amino acid sequences include the endogenous leader sequence. In other non-limiting examples the leaders sequence is human Tissue Plasminogen Activator (TPA) sequence, human CD5 leader sequence (e.g. MPMGSLQPLATLYLLGMLVASVLA (SEQ ID NO: 42)). Most of the chimeric designs include CD5 leader sequence. A skilled artisan appreciates that when used as immunogens, and for example when recombinantly produced, the amino acid sequences of these proteins do not comprise the leader peptide sequences.

The invention is directed to HIV-1 envelope immunogens which comprises changes in the amino acid sequence of glycosylation sites such that the envelope is partially deglycosylated. In certain embodiments deglycosylation is in the V1 loop of the HIV-1 envelope. In certain embodiments these changes are at positions N133, N138, N156, N301, N332, or any combination thereof. In certain embodiments where the envelope is deglycosylated at positions N133 and/or N138, the envelope is not glycosylated at positions N301 and N332. Position number given with respect to HXB2. Any suitable amino acid change is contemplated so longs as glycosylation at that position is abolished. Non-limiting embodiments include amino acids which are naturally occurring at the respective position in other envelopes and the envelopes are deglycosylated. Non-limiting amino acid changes include change to alanine, or any of the following: N133D, N138T, N301A, N301S, N332A, N332T. Any envelope form, e.g. but not limited to stabilized SOSIP trimer designs, gp140s, etc. could be designed to comprise deglycosylation mutations. In some embodiments, the envelope is CH848.3.D0949.10.17CHIM.6R.SOSIP.664V4.1_N133DN138T. In other embodiments, the envelope is CH848.3.D0949.10.17CHIM.6R.SOSIP.664V4.1_N133DN138T and further comprises N301mut.

The invention provides compositions comprising these deglycosylated envelopes. The invention provides methods of inducing immune response in a subject comprising administering compositions comprising deglycosylated envelopes. In some embodiments these deglycosylated envelopes are administered as a prime. In some embodiments, the prime could be a nucleic acid encoding a deglycosylated The glycosylated envelopes could also be administered as a boost.

The invention is described in the following non-limiting examples.

Nomenclature for trimers: chim.6R.DS.SOSIP.664 is SOSIP.I CHIM.6R.SOSIP.664 is SOSIP.II; CHIM.6R.SOSIP.664V4.1 is SOSIP.III. Additional designs of envelopes deglycosylated in the V1 loop are also contemplated and covered by the invention. Using the sequence information, annotations and listing of amino acid positions and changes, a skilled artisan can envision additional envelopes based on the sequence of CH848.3.D0949.10.17.

Non-limiting embodiments include chimeric trimer designs, which could comprise portions of BG505 envelope. FIG. 41C shows a non-limiting embodiment of a chimeric trimer design of a 6R. SOSIP664v4.1. Using this annotated sequence which shows the amino acids derived from BG505, a person of skill in the art could design any other chimeric trimer design. Non-limiting embodiments include non-chimeric trimer designs. See for example FIG. 54, 39A. Non-limiting embodiments of various deglycosylaton designs, trimer designs, chimeric or non-chimeric designs are summarized in Table 1, Table 3 and Table 4. A non-limiting example of a non-SOSIP trimer design is described in Kong et al. in *Nat Commun.* 2016 Jun. 28; 7:12040. doi: 10.1038/ncomms12040.

EXAMPLES

The following specific examples are to be construed as merely illustrative, and not limitative of the remainder of the disclosure in any way whatsoever. Without further elaboration, it is believed that one skilled in the art can, based on the description herein, utilize the present invention to its fullest extent.

Example 1 Staged Induction of HIV-1 Glycan-Dependent Broadly Neutralizing Antibodies Stages of V3-glycan neutralizing antibody maturation are identified that explain the long duration required for their development.

Abstract

A preventive HIV-1 vaccine should induce HIV-1 specific broadly neutralizing antibodies (bnAbs). However, bnAbs generally require high levels of somatic hypermutation (SHM) to acquire breadth and current vaccine strategies have not been successful in inducing bnAbs. Since bnAbs directed against a glycosylated site adjacent to the third variable loop (V3) of the HIV-1 envelope protein require limited SHM, the V3 glycan epitope is a desirable vaccine target. By studying the cooperation among multiple V3-glycan B-cell lineages and their co-evolution with autologous virus throughout 5 years of infection, we identify here key events in the ontogeny of a V3-glycan bnAb. Two autologous neutralizing antibody lineages selected for virus escape mutations and consequently allowed initiation and affinity maturation of a V3-glycan bnAb lineage. The nucleotide substitution required to initiate the bnAb lineage occurred at a low probability site for activation-induced cytidine deaminase activity. Cooperation of B-cell lineages and an improbable mutation critical for bnAb activity define the necessary events leading to V3-glycan bnAb development, explain why initiation of V3-glycan bnAbs is rare, and suggest an immunization strategy for inducing V3-glycan bnAbs.

Introduction

A vaccine to prevent HIV-1 infection should include immunogens that can induce broadly neutralizing antibodies (bnAbs) (1, 2). Of the five major targets for bnAbs, the glycan-rich apex of the HIV-1 envelope (Env) trimer and the base of the third variable loop (V3) are distinguished by the potency of antibodies directed against them (3-8). Although these antibodies have less breadth than those directed against the CD4 binding site (CD4bs) or the gp41 membrane-proximal region (MPER), one current goal of vaccine development is to elicit them in combination with other bnAb specificities to achieve broad coverage of transmitted/founder (TF) viruses to prevent HIV-1 integration upon exposure (1, 2).

Mapping the co-evolution of virus and antibody lineages over time informs vaccine design by defining the succession of HIV-1 Env variants that evolve in vivo during the course of bnAb development (9-11). Antibody lineages with overlapping specificities can influence each other's affinity maturation by selecting for synergistic or antagonistic escape mutations: an example of such "cooperating" lineages is provided by two CD4bs-directed bnAbs that we characterized previously (11, 12). Thus, cooperating antibody lineages and their viral escape mutants allow identification of the specific Envs, among the diverse repertoire of mutated Envs that develop within the autologous quasi-species in the infected individual, that stimulate bnAb development and that we wish to mimic in a vaccine.

Here we describe the co-evolution of an HIV-1 Env quasispecies and a memory B-cell lineage of gp120 V3-glycan directed bnAbs in an acutely infected individual followed over time as broadly neutralizing plasma activity developed. To follow virus evolution, we sequenced ~1,200 HIV-1 env genes sampled over a 5 year period; to follow the antibody response, we identified natural heavy- and light-chain pairs of six antibodies from a bnAb lineage, designated DH270, and augmented this lineage by next generation sequencing (NGS). Structural studies defined the position of the DH270 Fab on gp140 Env. We also found two B-cell lineages (DH272 and DH475) with neutralization patterns that likely selected for observed viral escape variants, which in turn stimulated the DH270 lineage to potent neutralization breadth. We found a mutation in the DH270 heavy chain that occurred early in affinity maturation at a disfavored activation-induced cytidine deaminase (AID) site and that was necessary for bnAb lineage initiation. This improbable mutation can explain the long period of antigenic stimulation needed for initial expansion of the bnAb B-cell lineage in this individual.

Results

Three N332 V3-Glycan Dependent Antibody Lineages

We studied an African male from Malawi (CH848) followed from the time of infection to 5 years post-transmission. He was infected with a clade C virus, developed plasma neutralization breadth 3.5 years post-transmission and did not receive antiretroviral therapy during this time as per country treatment guidelines. Reduced plasma neutralization of N332A Env-mutated HIV-1 pseudoviruses and plasma neutralization fingerprinting demonstrated the presence of N332-sensitive broadly neutralizing antibodies (bnAbs) (FIG. 29) (13). To identify these antibodies, we studied memory B cells from weeks 205, 232, and 234 post-infection using memory B cell cultures (14) and antigen-specific sorting (15, 16) and found three N332-sensitive lineages, designated DH270, DH272 and DH475. Their genealogy was augmented by NGS of memory B-cell cDNA from seven time points spanning week 11 to week 240 post-transmission.

Figure 1B:
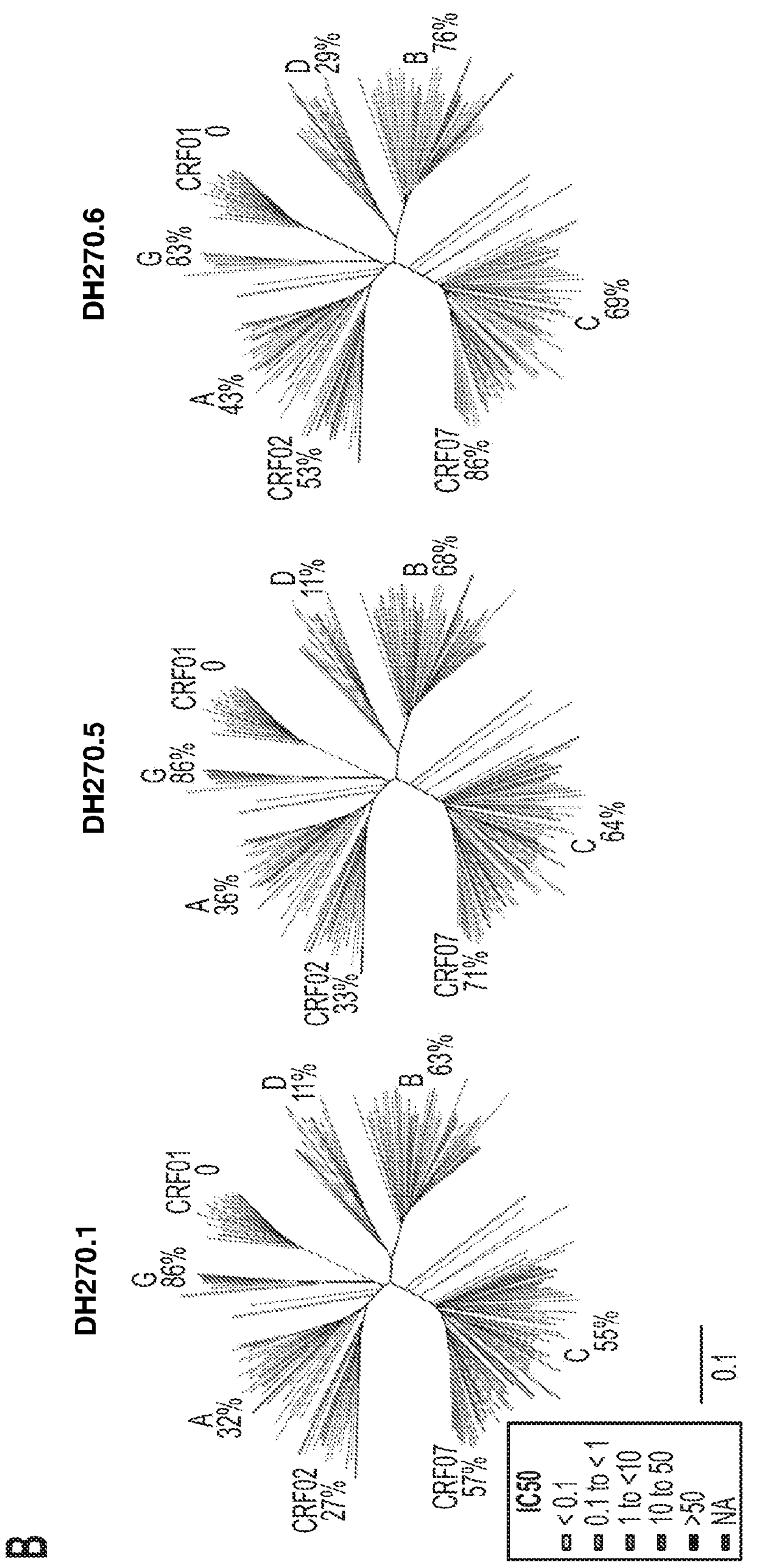

DH270 antibodies were recovered from memory B cells at all three sampling times (weeks 205, 232, and 234) and expansion of the clone did not occur until week 186 (FIG. 1A and FIGS. 30A-C). Clonal expansion was concurrent with development of plasma neutralization breadth (FIG. 31), and members of the DH270 lineage also displayed neutralization breadth (FIG. 1B and FIG. 33). The most potent DH270 lineage bnAb (DH270.6) was isolated using a fluorophore-labeled Man$_9$-V3 glycopeptide that is a mimic of the V3-glycan bnAb epitope (16) comprising a discontinuous 30 amino acid residue peptide segment within gp120 V3 and representative of the PGT128-bound minimal epitope described by Pejchal et al. (17). The synthetic Man$_9$-V3 glycopeptide includes high mannose glycan residues (Man$_9$) each at N301 and N332 and was synthesized using a chemical process similar to that described previously (18, 19). V3 glycan bnAb PGT128 affinity for the Man$_9$-V3 glycopeptide was similar to that of PGT128 for the BG505 SOSIP trimer and Man$_9$-V3 glycopeptide was therefore an effective affinity bait for isolating of V3 glycan bnAbs (16). The lineage derived from a $V_H$1-2*02 rearrangement that produced a CDRH3 of 20 amino acid residues paired with a light chain encoded by $V_\lambda$2-23 (FIGS. 7A-D). Neutralization assays and competition with V3-glycan bnAbs PGT125 and PGT128 confirmed lineage N332-dependence (FIGS. 8A-C).

Figure 9A:
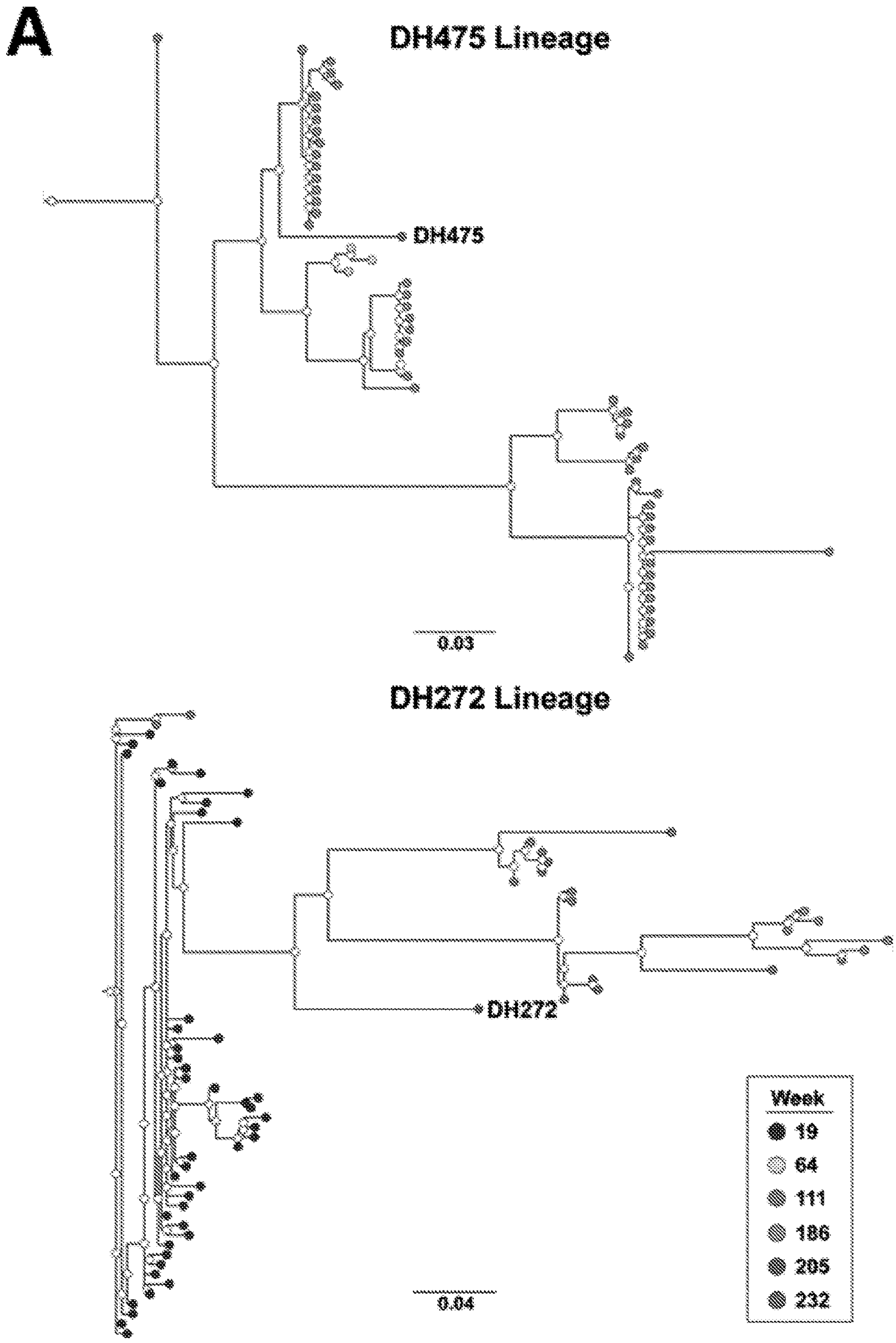

The DH475 mAb was recovered from memory B cells at week 232 post-transmission by antigen-specific sorting using the fluorophore-labeled Man$_9$-V3 glycopeptide (16). The earliest DH475 lineage $V_HDJ_H$ rearrangements were identified with NGS at week 64 post-transmission (FIG. 9A and FIGS. 30A-C). Its heavy chain came from $V_H$3-23*01 ($V_H$ mutation frequency=10.1%) paired with a $V_{\square}$4-69*02 light chain (FIG. 9B).

The DH272 mAb came from cultured memory B cells obtained at week 205 post-transmission. DH272 lineage $V_HDJ_H$ rearrangements were detected as early as 19 weeks post-transmission by NGS (FIG. 9A and FIGS. 30A-C). The DH272 heavy chain used $V_H$1-2*02, as did DH270, but it paired with a $V\kappa$ 2-30 light chain. Its CDRH3 was 17 amino acids long; $V_H$ mutation was 14.9%. DH272, an IgA isotype, had a 6-nt deletion in FRH3 (FIG. 9B).

Figure 9C:
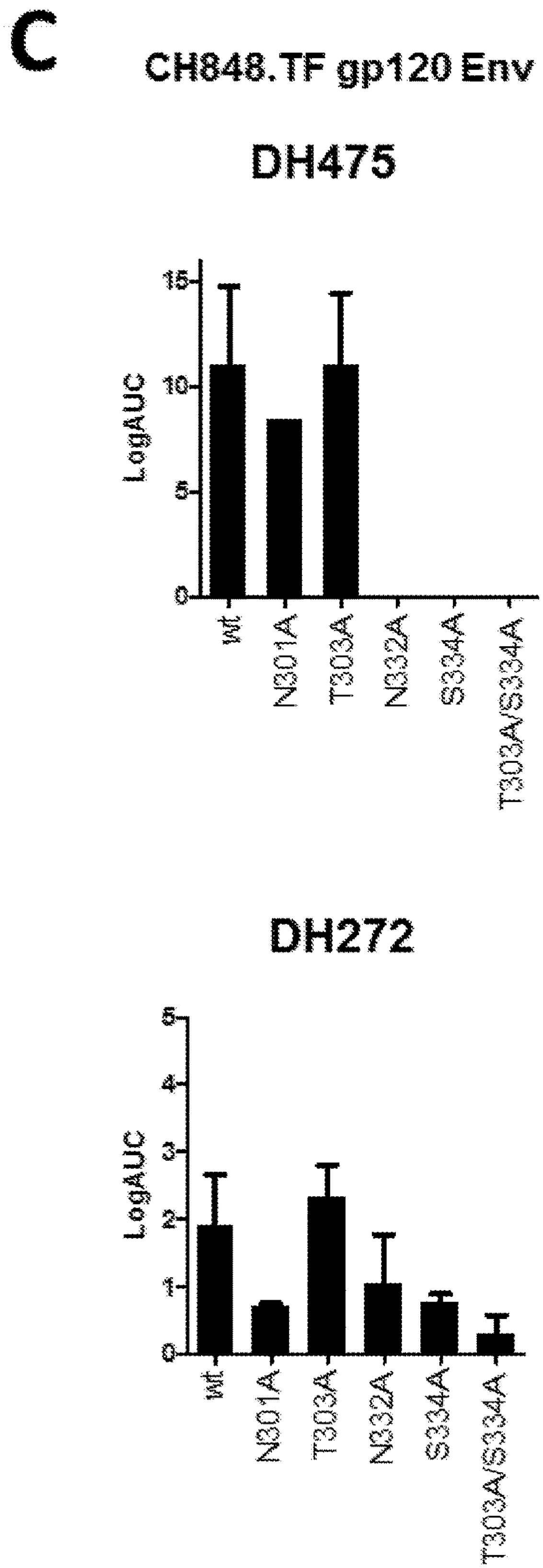
Figure 9D:
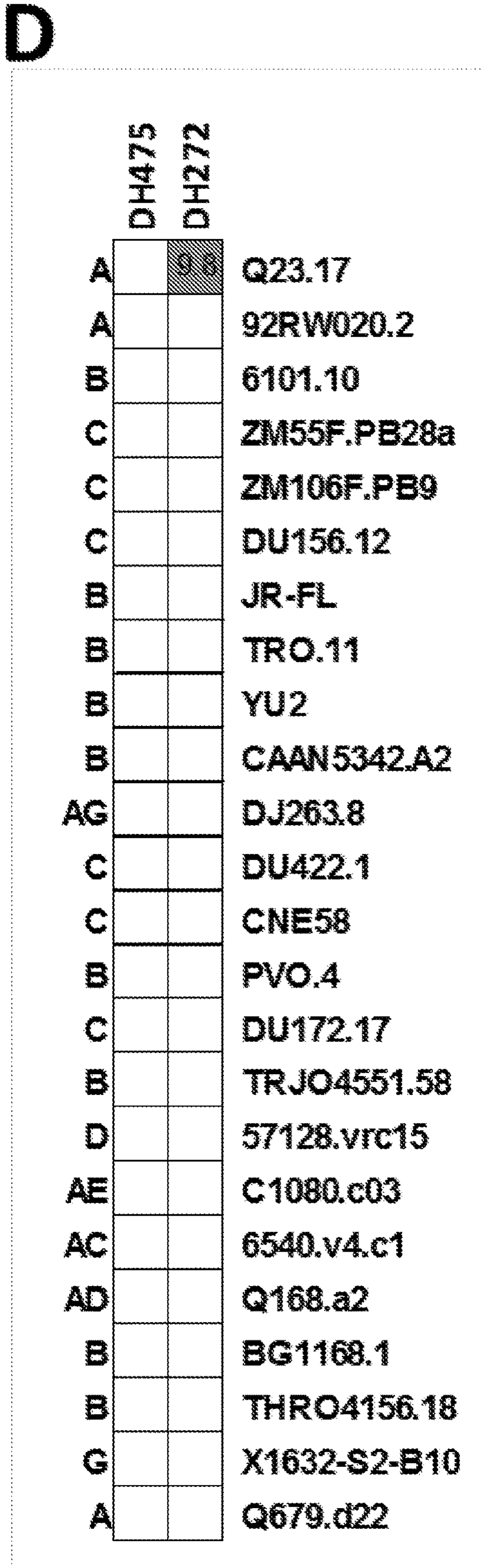

For both DH272 and DH475 lineages, binding to CH848 TF Env gp120 depended on the N332 potential N-linked glycosylation (PNG) site (FIG. 9C). DH272 binding also depended on the N301 PNG site (FIG. 9C). Neither lineage had neutralization breadth (FIG. 9D).

Evolution of the CH848 Virus Quasispecies

We sequenced 1,223 HIV-1 3'-half single-genomes from virus in plasma collected at 26 time points over 246 weeks. Analysis of sequences from the earliest plasma sample indicated that CH848 had been infected with a single, subtype clade C founder virus, ~17 (CI 14-19) days prior to screening (FIGS. 10 and 11A-B). By week 51 post-infection, 91% of the sequences had acquired an identical, 10-residue deletion in variable loop 1, a region that includes the PGT128-proximal residues 133-135 and 141 (FIGS. 12 and 13A-B). Further changes accrued during the ensuing four years, including additional insertions and deletions (indels) in V1, mutations in the $^{324}$GDIR$^{327}$ motif (SEQ ID NO: 34) within the V3 loop, deletion or shifting of N-linked glycosylation sites at positions 301 and 322, and mutations at PGT128-proximal positions in V1, V3, and C4, but none of these escape variants went to fixation during 4.5 years of follow-up (FIGS. 12-15).

Simultaneously with the first detection of DH270 lineage antibodies at week 186, four autologous virus clades emerged that defined distinct immunological resistance profiles of the CH848 autologous quasispecies (FIG. 12). The first clade included viruses that shifted the potential N-glycosylation (PNG) site at N332 to 334 (FIG. 12, open circles) and despite this mutation was associated with complete resistance to the DH270 lineage bnAbs, this clade was detected only transiently and at relatively low frequency (7-33% per sample), suggesting a balance where immune escape was countered by a cost in virological fitness. Conversely, viruses in the other three clades retained N332 and persisted throughout the 5 years of sampling. Viruses in the second clade resisted DH270 lineage neutralization and comprised gp120 Envs that were not bound by the DH270 antibodies (FIG. 12, triangles and FIGS. 34-35). The third and fourth clades defined autologous viruses whose gp120 Env was bound by DH270 lineage antibodies but that were either only weakly neutralized by the most mature members of the DH270 lineage (FIG. 12, "X" and FIGS. 34-35) or were completely neutralization resistant (FIG. 12, "+" and FIGS. 34-35), respectively. Persistence of four divergent clades in the CH848 Env, each with distinctive immunological resistance phenotypes, suggests that multiple distinctive immune escape routes were explored and selected, allowing continuing Env escape mutations to accrue in distinct frameworks and exposing the antibody to Env diversity that may have been necessary to acquire neutralization breadth.

Ontogeny of DH270 Lineage and Acquisition of Neutralization Breadth

Figure 2A:
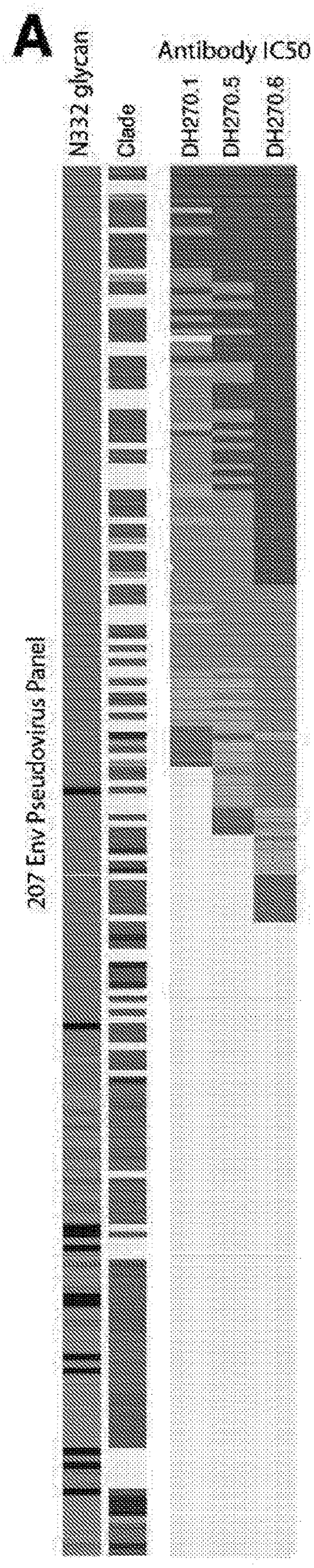

As with other V3-glycan bnAbs, viral neutralization clade specificity and intra-clade breadth of DH270 depended primarily on the frequency of the N332 glycosylation site within the relevant clade (FIG. 2A). Only one of 62 pseudoviruses tested that lacked the PNG site at N332, the B clade virus 5768.04, was sensitive to DH270.5 and DH270.6 (FIG. 33). Across the full M group HIV-1 virus isolate panel used in neutralization assays, the loss of the PNG N332 sites accounted for 70% of the observed neutralization resistance. The circulating recombinant form CRF01 very rarely has this glycosylation site (3% of sequences in the Los Alamos database and 4% (1/23) in our test panel) and DH270 lineage antibodies did not neutralize CRF01 strains (FIG. 2A). As a consequence of the N332 PNG site requirement of V3 glycan bnAbs to neutralize, in vitro estimation of neutralizing breadth was impacted simply by the fraction of CRF01 viruses included in the panel. Other V3-glycan bnAbs (10-1074, PGT121 and PGT128) shared this N332 glycan dependency but PGT121 and PGT128 were not as restrictive (FIG. 33) (5, 6, 8). Antibody 10-1074 was similar to DH270.6 in that it more strictly required the N332 PNG site, and its neutralization potency correlated with that of DH270.6 (Pearson's p=8.0e$^{-13}$, r=0.63) (8).

Figure 2B:
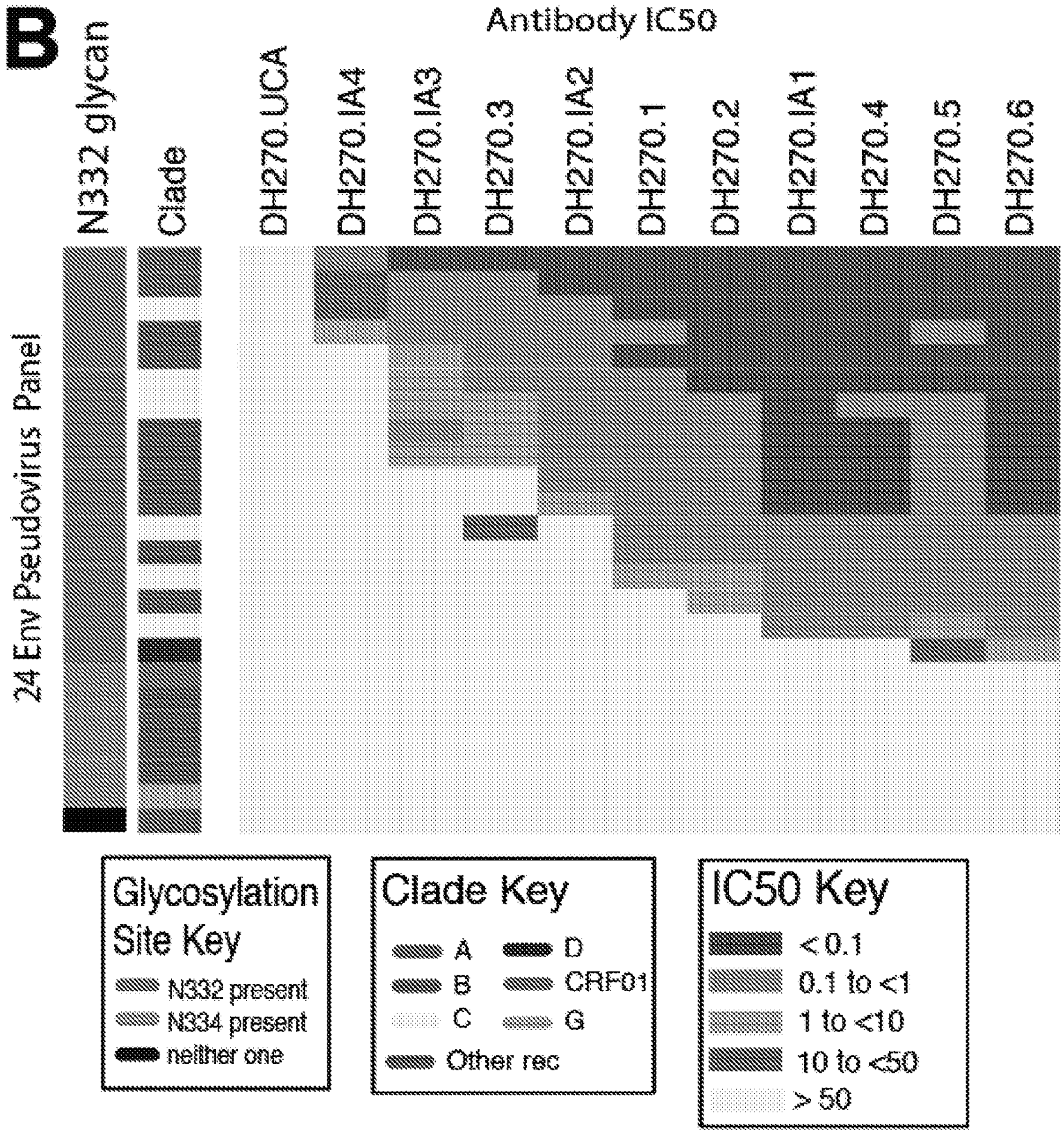
Figure 2C:
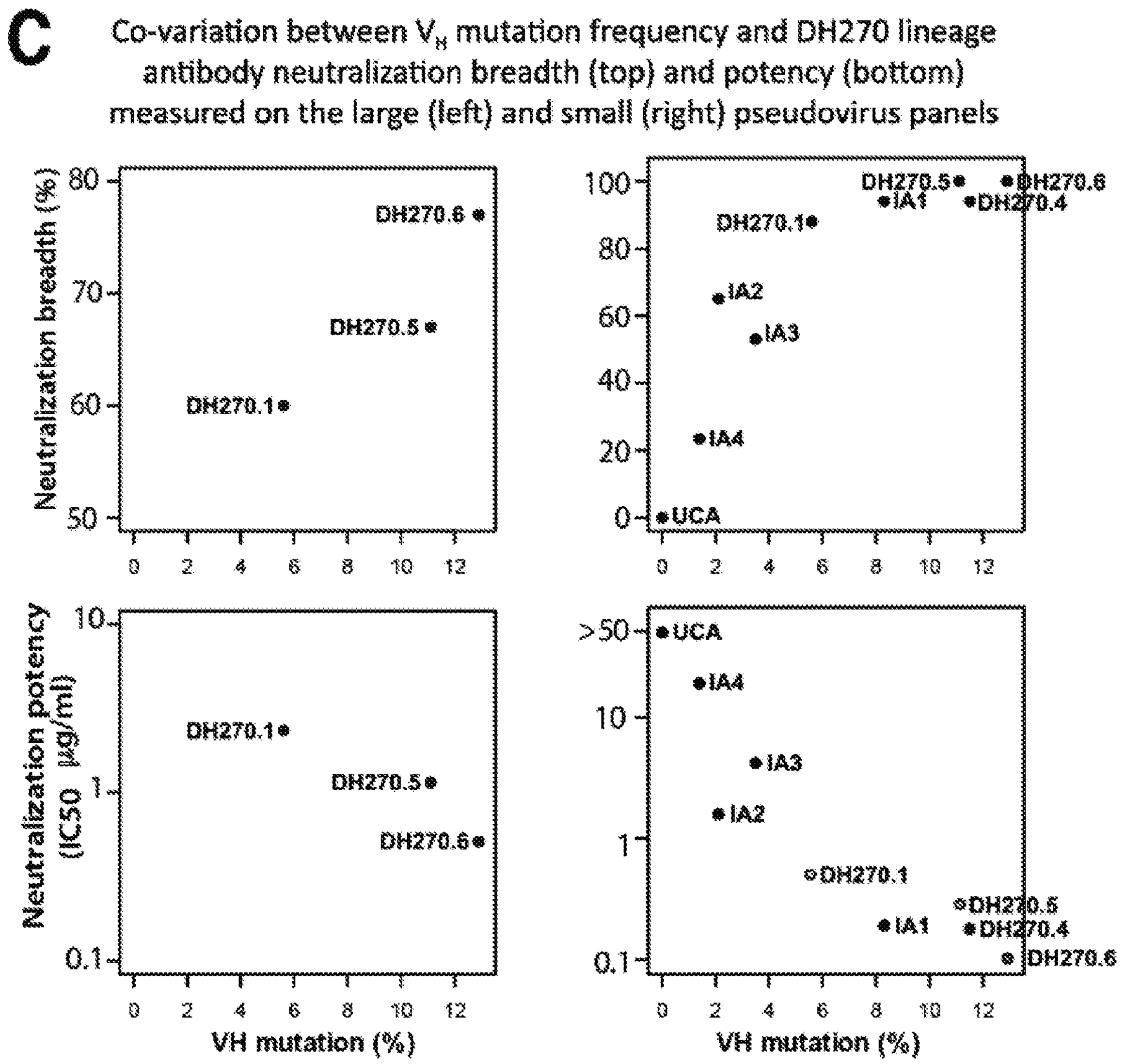

Heterologous breadth and potency of DH270 lineage antibodies increased with accumulation of $V_H$ mutations and although DH270.UCA did not neutralize heterologous HIV-1, five amino-acid substitutions in DH270.IA.4 (four in the heavy chain, one in the light chain) were sufficient to initiate the bnAb lineage and confer heterologous neutralization (FIGS. 2B, C and FIGS. 34-35).

Figures 16A, 16B, 16C, 16D, 16E, 16F:
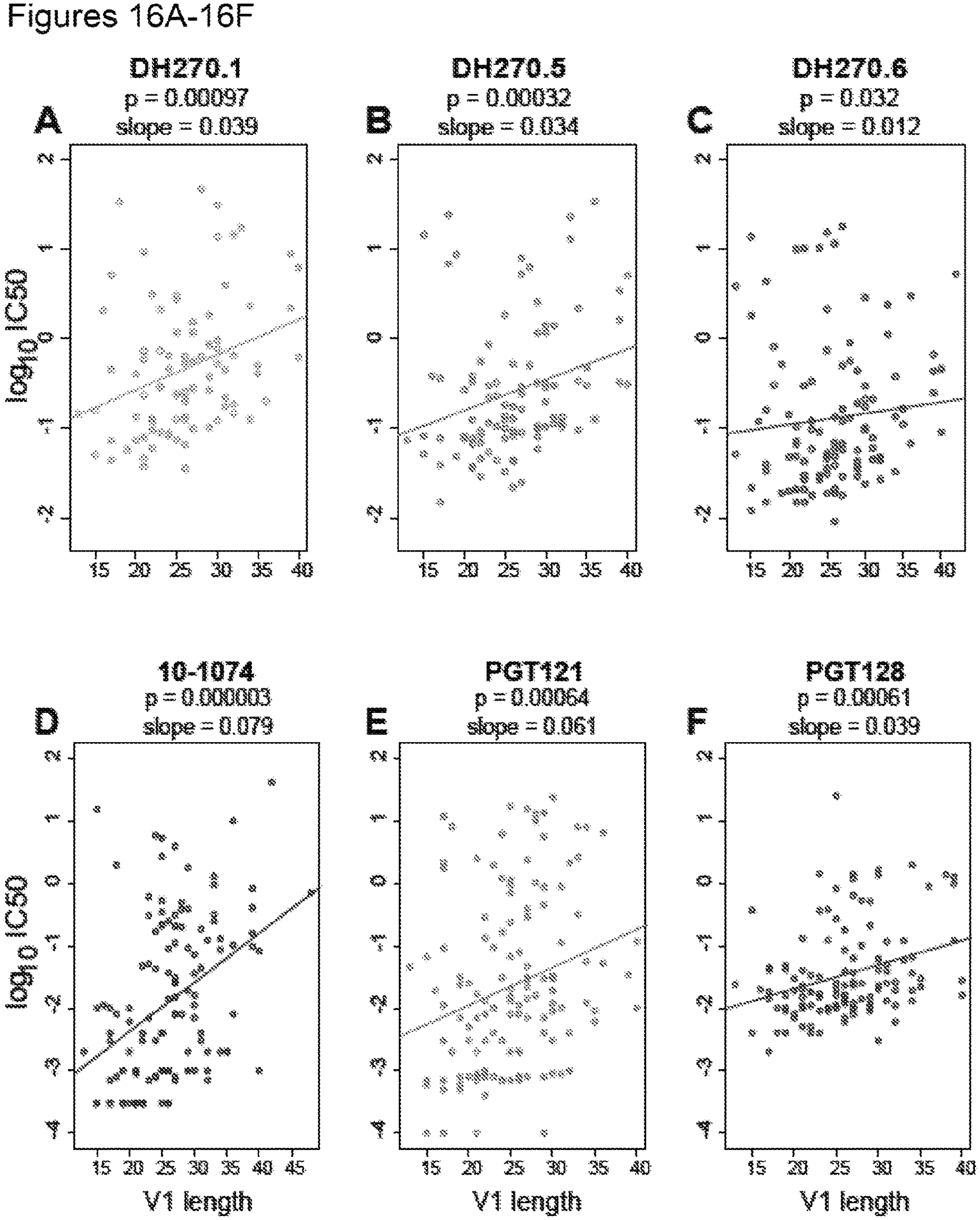

The capacity of the early DH270 lineage members to neutralize heterologous viruses correlated with the presence of short V1 loops (FIG. 2D). As the lineage evolved, it gained capacity to neutralize viruses with longer V1 loops, although with reduced potency (FIG. 2D and FIGS. 16A-C). Neutralization of the same virus panel by V3 glycan bnAbs 10-1074, PGT121 and PGT128 followed the same inverse correlation between potency and V1 length (FIGS. 16D-F).

Mutations in the DH270 Antibody Lineage that Initiated Heterologous Neutralization The likelihood of AID-generated somatic mutation in immunoglobulin genes has strong nucleotide-sequence dependence (20)(21). Moreover, we have recently shown for CD4bs bnAbs that $V_H$ sites of high intrinsic mutability indeed determine many sites of somatic hypermutation (11). Like the VRC01-class CD4bs bnAbs, both DH270 and DH272 used $V_H$1-2*02 although unlike the CD4bs bnAbs, V3 glycan bnAbs in general can use quite disparate $V_H$ gene segments (3, 17, 22-25), and antibodies in both lineages have mutations at the same amino acid positions that correspond to sites of intrinsic mutability that we identified in the $V_H$1-2*02 CD4bs bnAbs (11) (FIG. 17A). In HIV-1 negative individuals, we identified 20 aa that frequently mutate from the $V_H$1-2*02 germline sequence (FIG. 17A). Twelve of these 20 aa were also frequently mutated in DH270 lineage antibodies and 11 of these 12 aa mutated to one of the two most frequent aa mutated in non-HIV-1 $V_H$1-2*02 sequences (identity conformity). G57R was the lone exception. DH272 mutated in 6 of these 12 positions and CD4bs bnAb VRC01 mutated in 11 out of 12 positions (FIG. 17A).

Figure 3A:
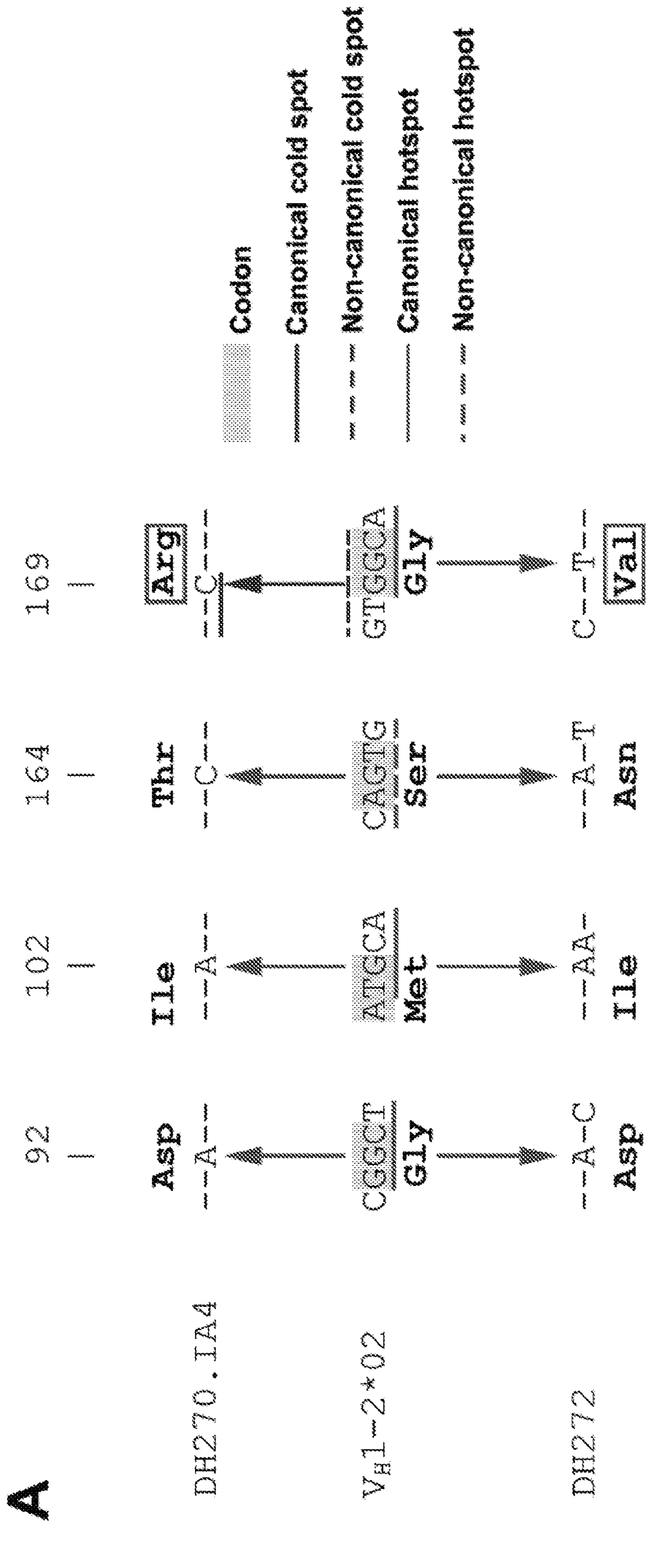

Presence of the canonical $V_H$1-2*02 allele in individual CH848 was confirmed by genomic DNA sequencing (FIG. 17B). Four nucleotide changes in the DH270 UCA conferred heterologous neutralization activity to the next intermediate antibody (IA4). The G92A and G102A nucleotide mutations in DH270.IA4 (and in DH272) occurred at "canonical" AID hotspots (DGYW) and encoded amino acid substitutions G31D and M34I, respectively (FIG. 3A). G164C (G164A for DH272) was in a "non-canonical" AID hotspot with a comparable level of mutability (20) and encoded the S55T (N for DH272) substitution (FIG. 3A). In contrast, the G169C mutation in DH270.IA4, which encoded the G57R amino acid mutation, occurred at a site with a very low predicted level of mutability (20), generated a canonical cold spot (GTC) and disrupted the overlapping AID hotspot at G170 within the same codon, which was instead used by DH272 and resulted in the G57V substitution (FIG. 3A). Thus, while both the DH270 bnAb and DH272 autologous neutralizing lineages had mutations at Gly57, the substitution in the DH270 lineage (G57R) was an improbable event whereas the substitution (G57V) in the DH272 lineage was much more probable.

Figures 3B, 3C:
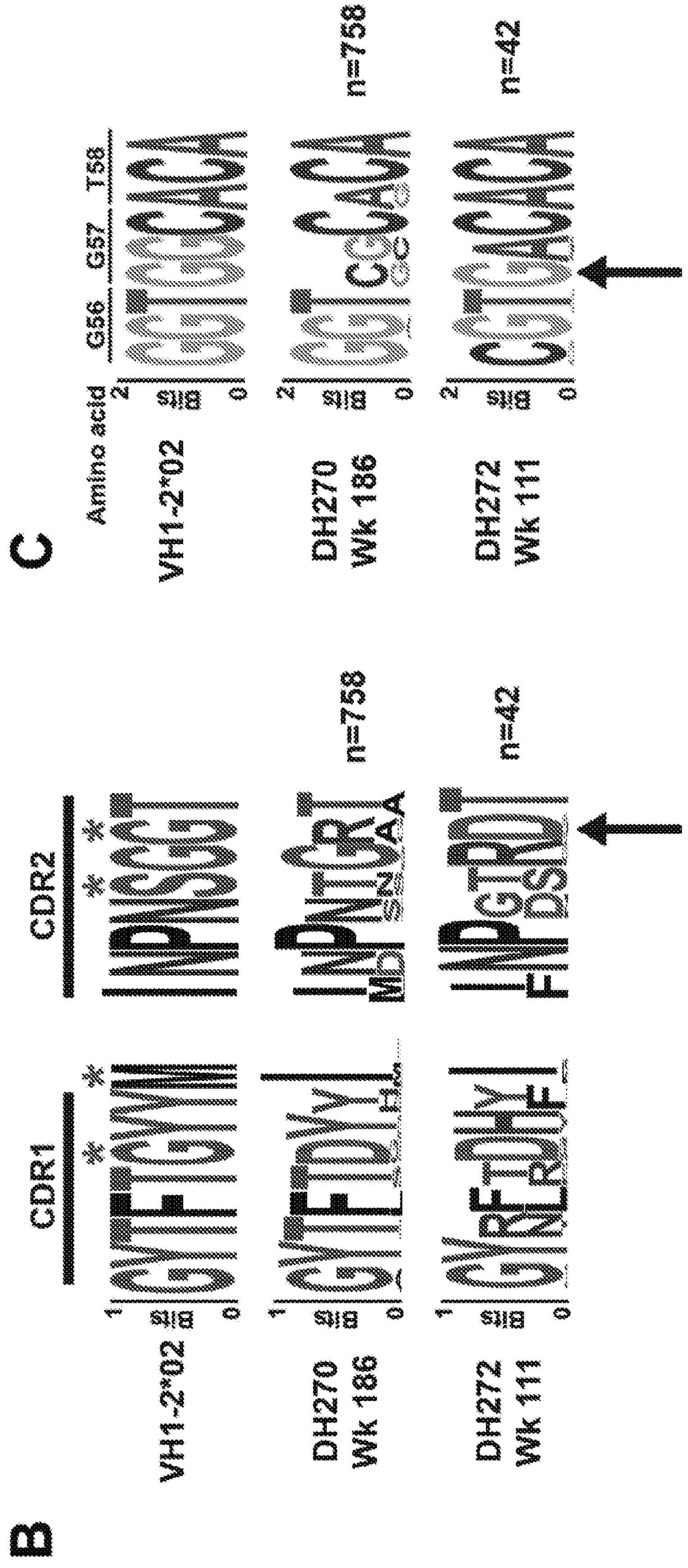

The G31D and M31I substitutions that occurred in AID hotspots became fixed in both lineages and S55T eventually became prevalent also in the DH272 lineage (FIG. 3B). By week 111 post-transmission, all DH272 lineage $V_HDJ_H$ transcripts sequenced by NGS harbored a mutation in the Gly57 codon, which resulted in the predominance of an encoded aspartic acid (FIG. 3B). In contrast, only 6/758 (0.8%) DH270 lineage transcripts isolated 186 weeks post-transmission had Val57 or Asp57; 48/758 (6.3%) retained Gly57, while over two-thirds, 514/758 (67.8%), had G57R (FIG. 3B).

Since the rare G169C nucleotide mutation in DH270.IA4 introduced a cold spot and simultaneously disrupted the overlapping AID hotspot, it had a high probability once it occurred of being maintained, and indeed it was present in 523/758 (68%) DH270 lineage $V_H$ sequences identified with NGS at week 186 post-transmission (FIG. 3C).

Figures 3D, 3E:
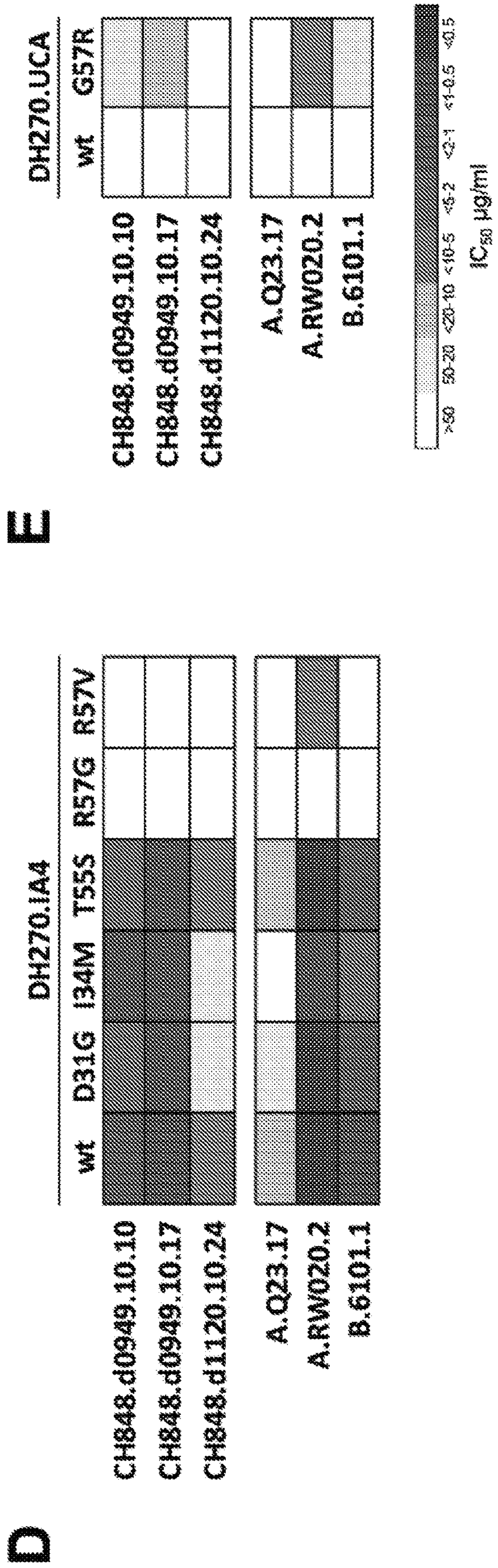

Reversion of Arg57 to Gly abrogated DH270.IA4 neutralization of autologous and heterologous HIV-1 isolates (FIG. 3D). A DH270.IA4 R57V mutant, with the base change that would have occurred had the overlapping AID hotspot been used, also greatly reduced DH270.IA4 neutralization, confirming that Arg57, rather than the absence of Gly57 was responsible for the acquired neutralizing activity (FIG. 3D). Finally, the DH270.UCA G57R mutant neutralized both autologous and heterologous viruses, confirming that G57R alone could confer neutralizing activity on the DH270 germline antibody (FIG. 3E). Thus, the improbable G169C mutation conferred reactivity against autologous virus and initiated acquisition of heterologous neutralization breadth in the DH270 lineage.

A search for an Env that might select for the critical G57R mutation in DH270 UCA or IA4-like antibodies yielded Env 10.17 from week 135 of infection (FIGS. 18A, B), which derived from the only autologous virus Env that DH270.IA4 could bind. DH270.IA4 binding to Env 10.17 depended on presence of Arg57 and reversion of R57G was necessary and sufficient to abrogate binding (FIG. 18A). Also, binding to Env 10.17 was acquired by DH270.UCA upon introduction of the G57R mutation (FIG. 18B).

Autologous Neutralizing Antibody Lineages that Cooperated with DH270

Evidence for functional interaction among the three N332-dependent lineages came from the respective neutralization profiles against a panel of 90 autologous viruses from transmitted/founder to week 240 post-transmission (FIG. 4A and FIGS. 34-35). Both DH475 and DH272 neutralized autologous viruses isolated during the first year of infection that were resistant to most DH270 lineage antibodies (only DH270.IA1 and DH270.4 neutralized weakly) (FIG. 4A). DH475 neutralized viruses from week 15 through week 39 and DH272 neutralized the CH848 transmitted/founder and all viruses isolated up to week 51, when viruses that resisted DH475 and DH272 became strongly sensitive to the more mature antibodies in the DH270 lineage ($V_H$ nt mutation frequency ≥5.6%) (FIG. 4A).

The identification of specific mutations implicated in the switch of virus sensitivity was complicated by the high levels of mutations accumulated by virus Env over time (FIG. 19 and FIG. 36). We identified virus signatures that defined the DH270.1 and DH272/DH475 immunotypes and introduced four of them, in various combinations, into the DH272/DH475-sensitive virus that was closest in sequence to the DH270.1-sensitive immunotype: a 10 amino-acid residue deletion in V1 (Δ134-143); a D185N mutation in V2, which introduced an N-linked glycosylation site; an N413Y mutation in V4, which disrupted an N-linked glycosylation site; and a 2 amino-acid residue deletion (Δ4. 63-464) in V5.

The large V1 deletion was critical for DH270.1 neutralization, with smaller contributions from the other changes; the V1 deletion increased virus resistance to DH475 (3.5- fold increase). V1-loop-mediated resistance to DH475 neutralization increased further when combined with the Δ463-464 V5 deletion (5-fold increase) (FIG. 4B).

Figures 20A, 20B, 20C, 20D, 20E, 20F:
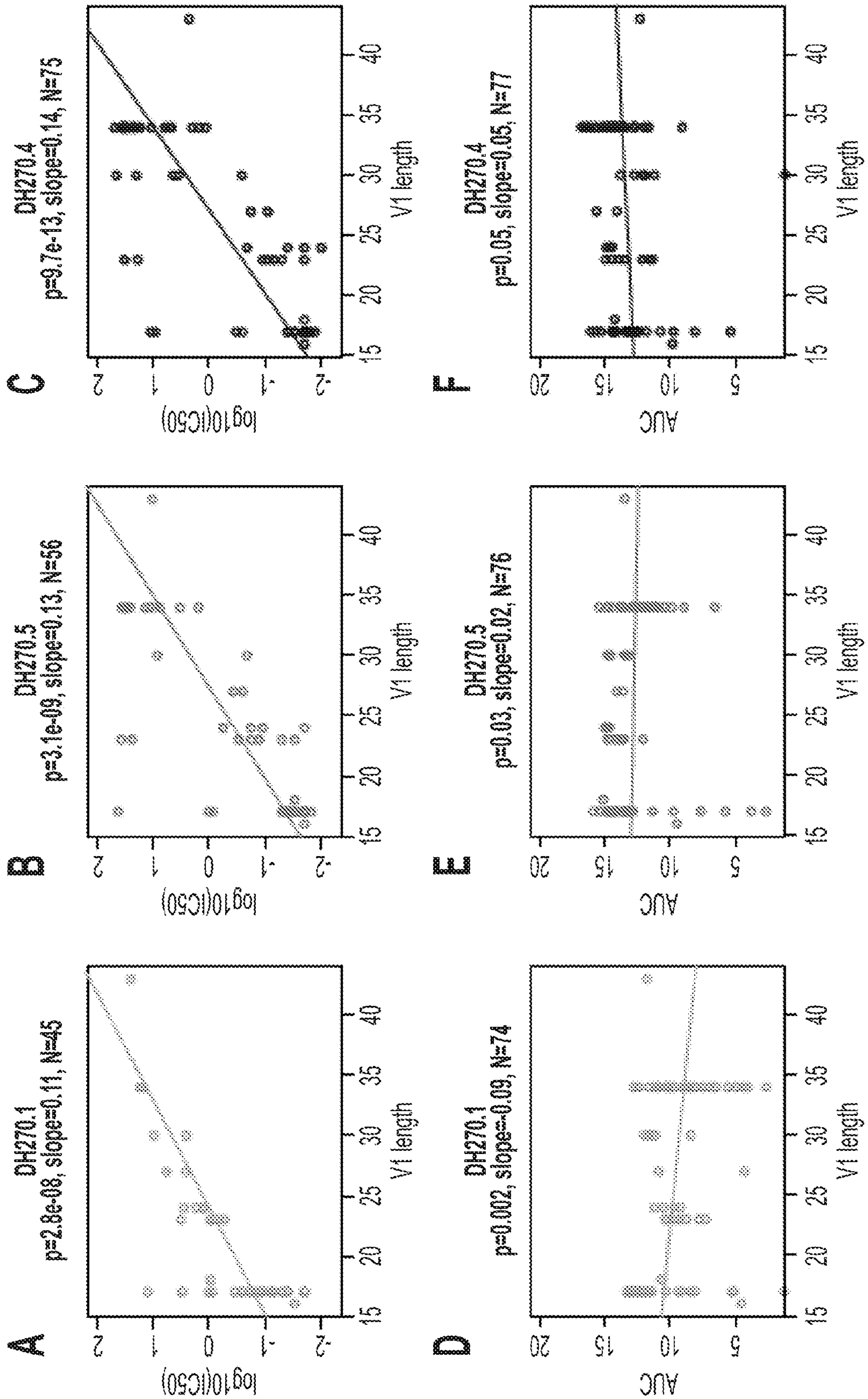

The V1 loop of the transmitted/founder virus (34 residues) was longer than the average V1 length of 28 residues (range 11 to 64) of HIV-1 Env sequences found in the Los Alamos Sequence Database (26). As we found for heterologous neutralization, DH270 lineage antibodies acquired the ability to neutralize larger fractions of autologous viruses as maturation progressed by gaining activity for viruses with longer V1 loops, although at the expense of lower potency (FIGS. 20A-C). This correlation was less clear for gp120 binding (FIGS. 20D-F), however, suggesting that the V1 loop-length dependency of V3 glycan bnAb neutralization has a conformational component. Thus, DH475 cooperated with the DH270 bnAb lineage by selecting viral escape mutants sensitive to bnAb lineage members.

For DH272, the viral variants that we made did not implicate a specific cooperating escape mutation. The Δ134-143 (V1 deletion) mutated virus remained sensitive to DH272 neutralization; both combinations of the V1 deletion in our panel that were resistant to DH272 and sensitive to DH270.1 included D185N, which on its own also caused DH272 resistance but did not lead to DH270.1 sensitivity (FIG. 4C). Thus, we have suggestive, but not definitive, evidence that DH272 also participated in selecting escape mutants for the DH270 bnAb lineage.

Structure of DH270 Lineage Members

Figures 5A, 5B:
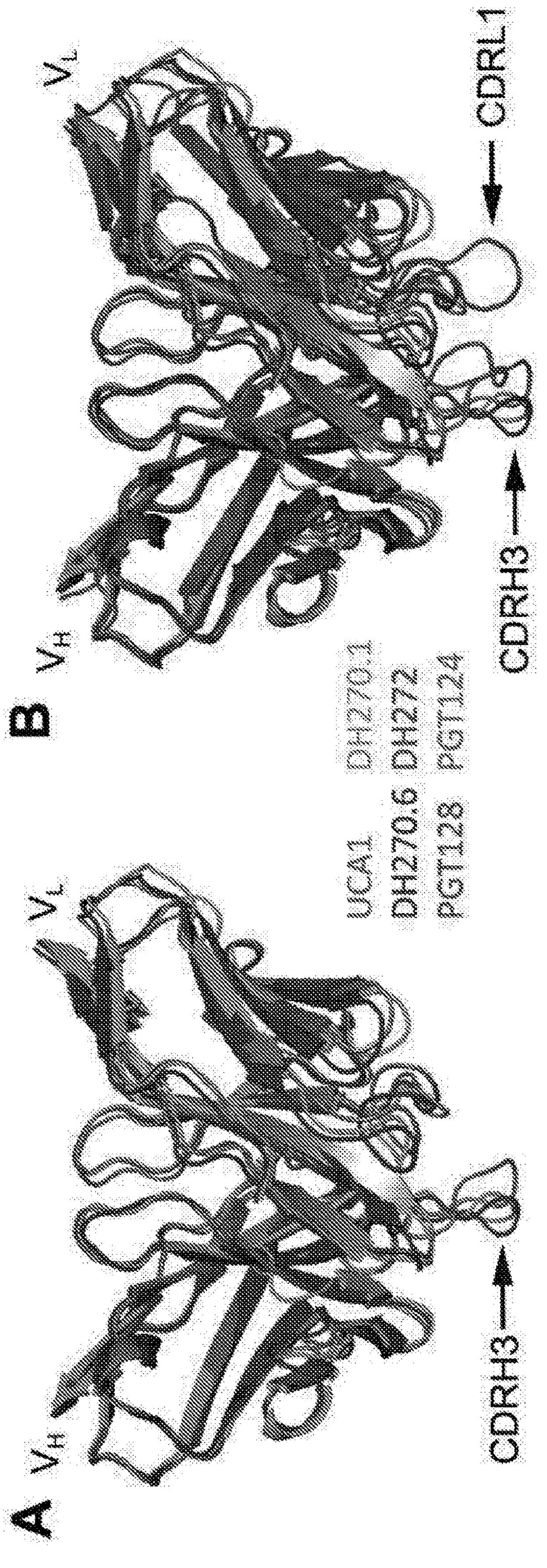
Figures 5C, 5D:
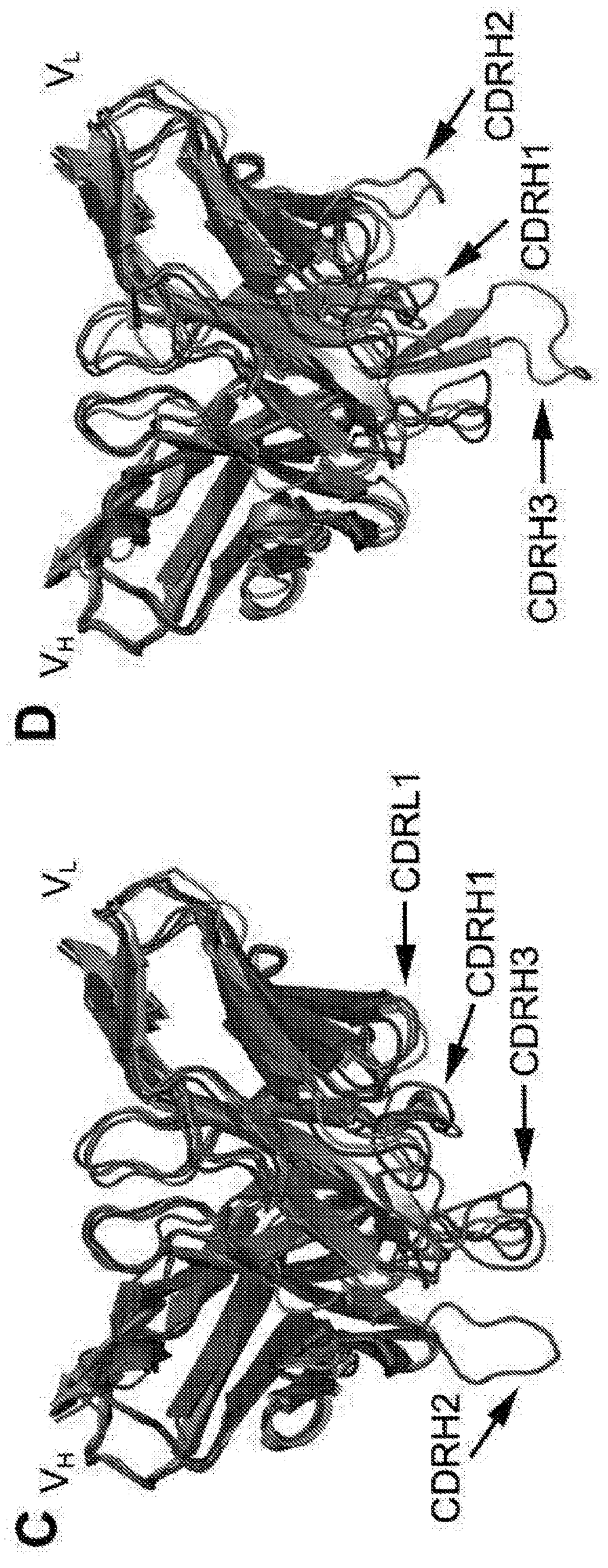

We determined crystal structures for the single-chain variable fragment of DH270.1 and the Fabs of DH270.UCA3, DH270.3, DH270.5 and DH270.6, as well as for DH272 (FIG. 32). Because of uncertainty in the inferred sequence of the germline precursor (FIGS. 21A, B), we also determined the structure of DH270.UCA1, which has a somewhat differently configured CDR H3 loop (FIG. 21C); reconfiguration of this loop during early affinity maturation could account for the observed increase with respect to the UCA in heterologous neutralization by several intermediates. The variable domains of the DH270 antibodies superposed well, indicating that affinity maturation modulated the antibody-antigen interface without substantially changing the antibody conformation (FIG. 5A). Mutations accumulated at different positions for DH270 lineage bnAbs in distinct branches (FIG. 22), possibly accounting for their distinct neutralization properties. DH272 had a CDRH3 configured differently from that of DH270 lineage members and a significantly longer CDRL1 (FIG. 5B), compatible with their distinct neutralization profiles.

We also compared the structures of DH270 lineage members with those of other N332-dependent bnAbs. All appear to have one long CDR loop that can extend through the network of glycans on the surface of the gp120 subunit and contact the "shielded" protein surface. The lateral surfaces of the Fab variable module can then interact with the reconfigured or displaced glycans to either side. PGT128 has a long CDRH2 (FIG. 5C), in which a 6-residue insertion is critical for neutralization breadth and potency (5, 17). PGT124 has a shorter and differently configured CDR H2 loop, but a long CDR H3 instead (FIG. 5D) (27).

Structure of the DH270—HIV Env Complex

Figures 5E, 5F:
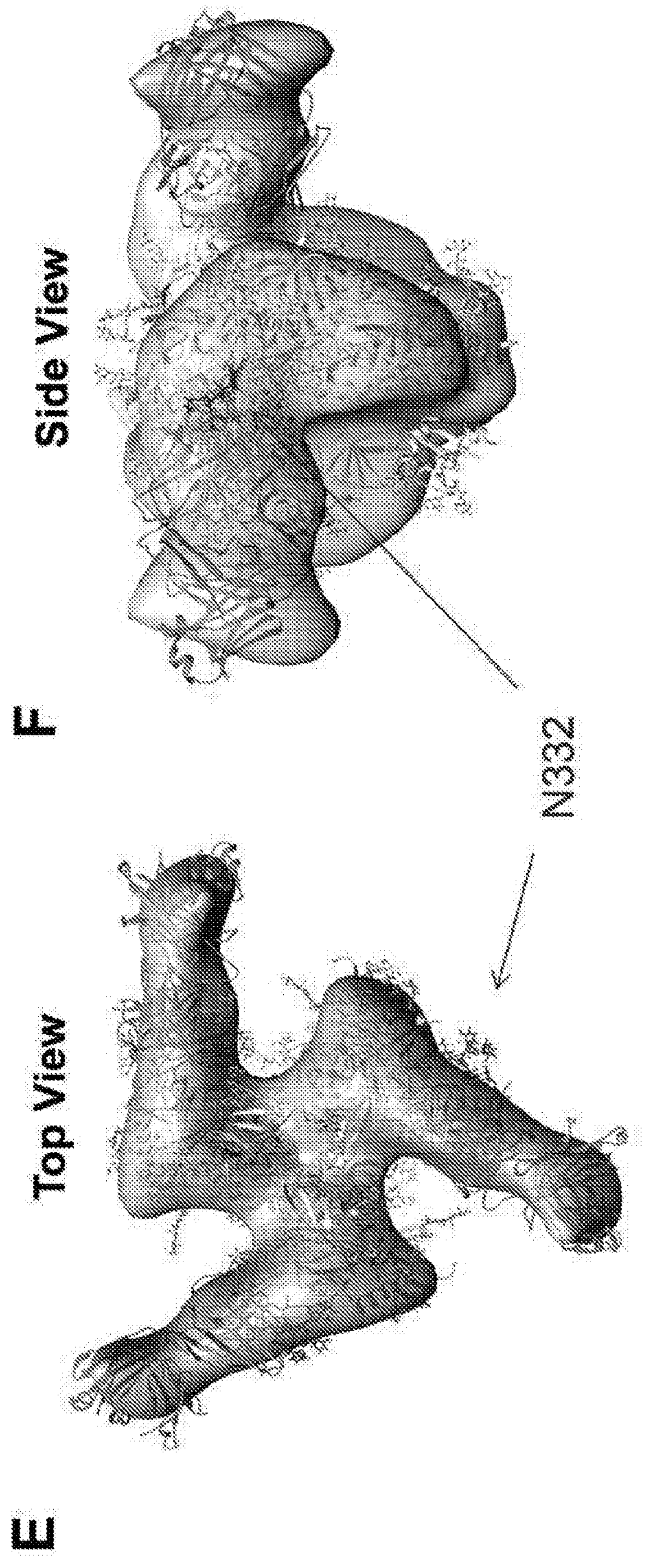
Figures 5G, 5H:
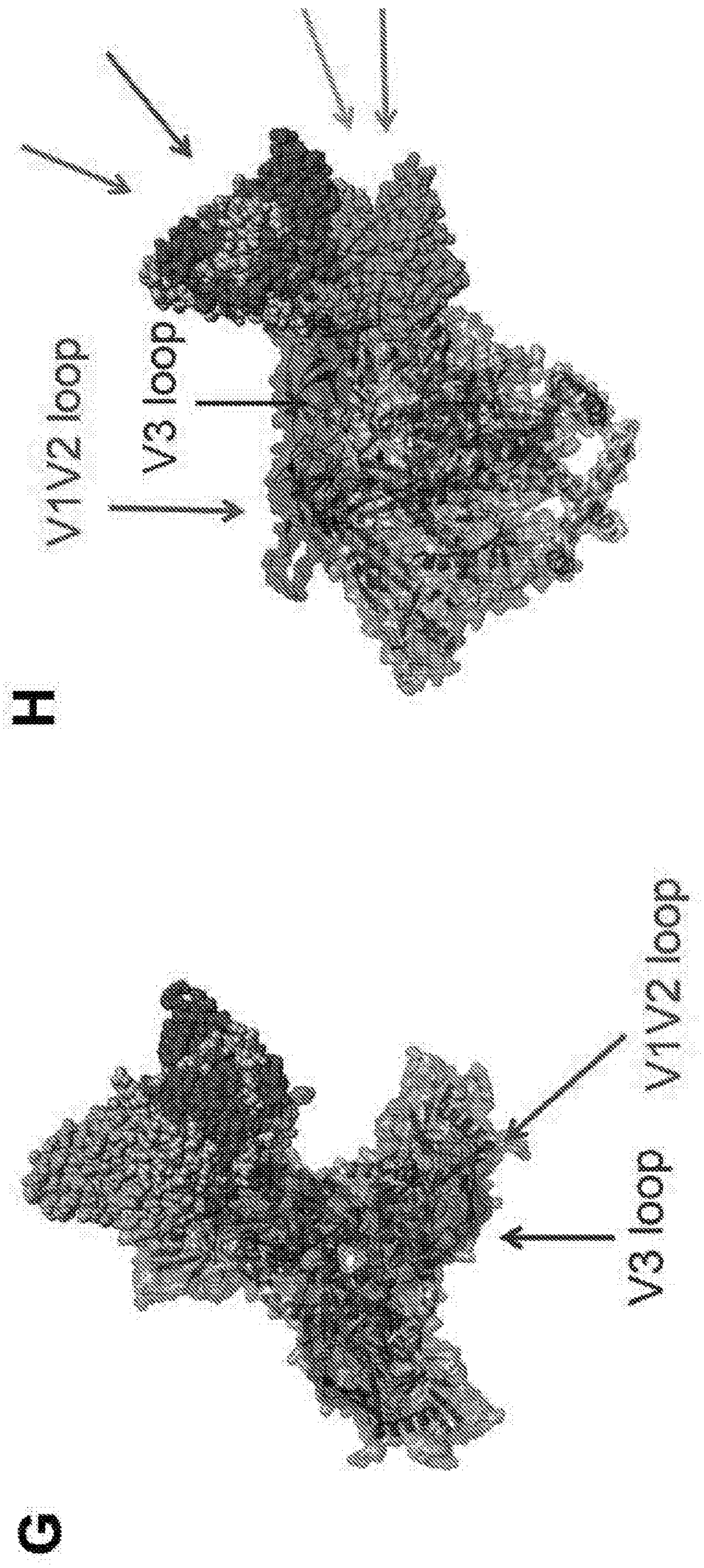

We determined a three-dimensional (3D) image reconstruction, from negative-stain electron microscopy (EM), of the DH270.1 Fab bound with a gp140 trimer (92Br SOSIP.664) (FIGS. 5E, F and FIGS. 23A-B). The three DH270.1 Fabs project laterally, with their axes nearly normal to the threefold of gp140, in a distinctly more "horizontal" orientation than seen for PGT124, PGT135 and PGT128 (FIGS. 5G, H and FIG. 24). This orientational difference is consistent with differences between DH270 and PGT124 or PGT128 in the lengths and configurations of their CDR loops, which required an alternative DH270 bnAb position when docked onto the surface of the Env trimer. We docked the BG505 SOSIP coordinates (28) and the Fab into the EM reconstruction, and further constrained the EM reconstruction image by the observed effects of BG505 SOSIP mutations in the gp140 surface image (FIGS. 23A-B and FIGS. 25A-B). Asp325 was essential for binding DH270.1 since it is a potential partner for Arg57 on the Fab. Mutating Asp321 led to a modest loss in affinity; R327A had no effect (FIG. 26A-C). These data further distinguish DH270 from PGT124 and PGT128. Mutating W101, Y105, D107, D115, Y116 or W117 in DH270.1 individually to alanine substantially reduced binding to the SOSIP trimer, as did pairwise mutation to alanines of S106 and S109. The effects of these mutations illustrate the critical role of the CDRH3 loop in binding with HIV-1 Env (FIGS. 26A-C).

DH270 UCA Binding

The DH270 UCA did not bind to any of the 120 CH848 autologous gp120 Env glycoproteins isolated from time of infection to 245 weeks post-infection, including the TF Env (FIG. 6A). DH270 UCA, as well as maturation intermediate antibodies, also did not recognize free glycans or cell surface membrane expressed gp160 trimers (FIG. 6B). Conversely, the DH270 UCA bound to the $Man_9$-V3 synthetic glycopeptide mimic of the V3-glycan bnAb gp120 epitope (FIG. 27A) and also bound to the aglycone form of the same peptide (FIG. 27B). Similarly, the early intermediate antibodies (IA4, IA3, IA2) each bound to both the $Man_9$-V3 glycopeptide and its aglycone form, and their binding was stronger to the aglycone V3 peptide than to the $Man_9$-V3 glycopeptide (FIG. 27B). Overall, DH270 UCA and early intermediate antibodies binding to the $Man_9$-V3 glycopeptide was low (>10 M) (FIG. 27A). DH270.1 ($V_H$ nt mutation frequency: 5.6%) bound the glycopeptide with higher affinity than did the aglycone ($K_{d,glycopeptide}$=331 nM) (FIGS. 27A, B) and, as mutations accumulated, binding of the $Man_9$-V3 glycopeptide also increased, culminating in a $K_d$ of 188 nM in the most potent bnAb, DH270.6, which did not bind to the aglycone-V3 peptide (FIGS. 27A, B). Thus, both the $Man_9$-V3 glycopeptide and the aglycone-V3 peptide bound to the DH270 UCA, and antibody binding was independent of glycans until the DH270 lineage had acquired a nucleotide mutation frequency of ~6%.

DISCUSSION

We can reconstruct from the data presented here a plausible series of events during the development of a V3-glycan bnAb in a natural infection. The DH272 and DH475 lineages neutralized the autologous TF and early viruses, and the resulting escape viruses were neutralized by the DH270 lineage. In particular, V1 deletions were necessary for neutralization of all but the most mature DH270 lineage antibodies. DH475 (and possibly DH272) escape variants stimulated DH270 affinity maturation, including both somatic mutations at sites of intrinsic mutability (11) and a crucial, improbable mutation at an AID cold spot within CDRH2 (G57R). The G57R mutation initiated expansion of the DH270 bnAb lineage. The low probability of this heterologous neutralization-conferring mutation and the complex lineage interactions that occurred is one explanation for why it took 4.5 years for the DH270 lineage to expand.

The CH848 viral population underwent a transition from a long V1 loop in the TF (34 residues) to short loops (16-17 residues) when escaping DH272/DH475 and facilitating expansion of DH270, to restoration of longer V1 loops later in infection as resistance to DH270 intermediates developed. Later DH270 antibodies adapted to viruses with longer V1 loops, allowing recognition of a broader spectrum of Envs and enhancing breadth. DH270.6 could neutralize heterologous viruses regardless of V1 loop length, but viruses with long loops tended to be less sensitive to it. Association of long V1 loops with reduced sensitivity was evident for three other V3 glycan bnAbs isolated from other individuals and may be a general feature of this class.

The V1 loop deletions in CH848 autologous virus removed the PNG site at position 137. While the hypervariable nature of the V1 loop (which evolves by insertion and deletion, resulting in extreme length heterogeneity, as well as extreme variation in number of PNG sites) complicates the interpretation of direct comparisons among unrelated HIV-1 strains, it is worth noting that a PNG in this region specified as N137 was shown to be important for regulating affinity maturation of the PGT121 V3 glycan bnAb family, with some members of the lineage evolving to bind (PGT121-123) and others (PGT124) to accommodate or avoid this glycan (29).

Since we cannot foresee the susceptibility to a particular bnAb lineage of each specific potential transmitted/founder virus to which vaccine recipients will be exposed, it will be important for a vaccine to induce bnAbs against multiple epitopes on the HIV-1 Env to minimize transmitted/founder virus escape (30, 31). In particular, induction of bnAb specificities beyond the HIV-1 V3 glycan epitope is critical for use in Asian populations where CRF01 strains, which lack for the most part the N332 PNG required for efficient neutralization by V3 glycan bnAbs, is frequently observed.

Regarding what might have stimulated the UCA of the DH270 bnAb lineage, the absence of detectable binding to the CH848 TF Env raised at least two possibilities. One is that the lineage arose at the end of year 1, either from a primary response to viruses present at that time (e.g., with deletions in V1-V2) or from subversion of an antibody lineage initially elicited by some other antigen. The other is that some altered form of the CH848 TF envelope protein (e.g. shed gp120, or a fragment of it) exposed the V3 loop and the N301 and N332 glycans in a way that bound and stimulated the germline BCR, even though the native CH848 TF Env did not. Our findings suggest that a denatured, fragmented or otherwise modified form of Env may have initiated the DH270 lineage. We cannot exclude that the DH270 UCA could not bind to autologous Env as an IgG but could potentially be triggered as an IgM B cell receptor (BCR) on a cell surface.

It will be important to define how often an improbable mutation such as G57R determines the time it takes for a bnAb lineage in an HIV-1 infected individual to develop, and how many of the accompanying mutations are necessary for potency or breadth rather than being non-essential mutations at AID mutational hotspots (11, 32). Mutations of the latter type might condition the outcome or modulate the impact of a key, improbable mutation, without contributing directly to affinity. Should the occurrence of an unlikely mutation be rate-limiting for breadth or potency in many other cases, a program of rational immunogen design will need to focus on modified envelopes most likely to select very strongly for improbable yet critical antibody nucleotide changes The following proposal for a strategy to induce V3 glycan bnAbs recreates the events that led to bnAb induction in CH848: start by priming with a ligand that binds the bnAb UCA, such as the synthetic glycopeptide mimic of the V3-glycan bnAb gp120 epitope, then boost with an Env that can select G57R CDR H2 mutants, followed by Envs with progressive V1 lengths (FIG. 28). We hypothesize that more direct targeting of V3-glycan UCAs and intermediate antibodies can accelerate the time of V3-glycan bnAb development in the setting of vaccination.

A limitation of this approach is that the selection of immunogens was based on the analysis of a single lineage from a single individual and how frequently DH270-like lineages are present in the general population is unknown. Finally, our study describes a general strategy for the design of vaccine immunogens that can select specific antibody mutations thereby directing antibody lineage maturation pathways.

Material and Methods

Study Design. The CH848 donor, from which the DH270, DH272 and DH475 antibody lineages were isolated, is an African male enrolled in the CHAVI001 acute HIV-1 infection cohort (33) and followed for 5 years, after which he started antiretroviral therapy. During this time viral load ranged from 8,927 to 442,749 copies/ml (median=61,064 copies/ml), and CD4 counts ranged from 288 to 624 cells/$mm^3$ (median=350 cells/$mm^3$). The time of infection was estimated by analyzing the sequence diversity in the first available sample using the Poisson Fitter tool as described in (10). Results were consistent with a single founder virus establishing the infection (34).

MAbs DH270.1 and DH270.3 were isolated from cultured memory B cells isolated 205 weeks post-transmission (14). DH270.6 and DH475 mAbs were isolated from $Man_9$-V3 glycopeptide-specific memory B cells collected 232 and 234 weeks post-transmission, respectively, using direct sorting. DH270.2, DH270.4 and DH270.5 mAbs were isolated from memory B cells collected 232 weeks post-transmission that bound to Consensus C gp120 Env but not to Consensus C N332A gp120 Env using direct sorting Statistical Analyses. Statistical analysis was performed using R. The specific tests used to determine significance are reported for each instance in the text.

Flow Cytometry, Memory B Cell Cultures and mAb Isolation

A total of 30,700 memory B cells from individual CH848 were isolated from PBMC collected 205 weeks post-transmission using magnetic-activated cell sorting as described in (14). Memory B cells were cultured at limiting dilution at a calculated concentration of 2 cells/well for 2 weeks as described in (11) using irradiated CD40L L cells (7,500 cGy) as feeder cells at a concentration of 5,000 cells/well; culture medium was refreshed 7 days after plating. Cell culture supernatants were screened for neutralization of autologous CH848.TF virus using the tzm-bl neutralization assay (14) and for binding to CH848.TF gp120 Env, CH848.TF gp140 Env, Consensus C gp120 Env and consensus C N332A gp120 Env. Concurrently, cells from each culture were transferred in RNAlater (Qiagen) and stored at −80° C. until functional assays were completed.

MAbs DH270.1 and DH270.3 were isolated from cultures that bound to CH848.TF gp120 Env and Consensus C gp120 but did not bind to C N332A gp120 Env. DH272 was isolated from a culture that neutralized 99% CH848.TF virus infectivity. DH272 dependency to N332-linked glycans was first detected on the transiently transfected recombinant antibody tested at higher concentration and confirmed in the purified recombinant antibody. From the stored RNAlater samples, mRNA of cells from these cultures was extracted and retrotranscribed as previously described (14).

DH270.6 and DH475 mAbs were isolated from Man9-V3 glycopeptide-specific memory B cells collected 232 and 234 weeks post-transmission, respectively, using direct sorting (16). Briefly, biotinylated Man9-V3 peptides were tetramerized via streptavidin that was conjugated with either AlexaFluor 647 (AF647; ThermoScientific) or Brilliant Violet 421 (BV421) (Biolegend) dyes. Peptide tetramer quality following conjugation was assessed by flow cytometry to a panel of well-characterized HIV-1 V3 glycan antibodies (PGT128, and 2G12) and linear V3 antibodies (F39F) attached to polymer beads. PBMCs from donor CH848 were stained with LIVE/DEAD Fixable Aqua Stain (ThermoScientific), anti-human IgM (FITC), CD3 (PE-Cy5), CD235a (PE-Cy5), CD19 (APC-Cy7), and CD27 (PE-Cy7) (BD Biosciences); anti-human antibodies against IgD (PE); anti-human antibodies against CD10 (ECD), CD38 (APC-AF700), CD19 (APC-Cy7), CD16 (BV570), CD14 (BV605) (Biolegend); and Man9GlcNac2 V3 tetramer in both AF647 and BV421. PBMCs that were Aqua Stain−, CD14−, CD16−, CD3−, CD235a−, positive for CD19+, and negative for surface IgD were defined as memory B cells; these cells were then gated for Man9-V3+ positivity in both AF647 and BV421, and were single-cell sorted using a BD FACS Aria II into 96-well plates containing 20l of reverse transcriptase buffer (RT).

DH270.2, DH270.4 and DH270.5 mAbs were isolated from memory B cells collected 232 weeks post-transmission that bound to Consensus C gp120 Env but not to Consensus C N332A gp120 Env using direct sorting. Reagents were made using biotinylated Consensus C gp120 Env and Consensus C N332A gp120 Env by reaction with streptavidin that was conjugated with either AlexaFluor 647 (AF647; ThermoScientific) or Brilliant Violet 421 (BV421) (Biolegend) dyes, respectively. Env tetramer quality following conjugation was assessed by flow cytometry to a panel of well-characterized HIV-1 V3 glycan antibodies (PGT128, and 2G12) and linear V3 antibodies (F39F) attached to polymer beads. PBMCs were stained as outlined for DH475 and DH270.6, however these cells were then gated for Consensus C gp120 positivity and Consensus C N332A gp120 negativity in AF647 and BV421, respectively, and were single cell sorted and processed as outlined for DH475 and DH270.6.

For all antibodies, cDNA synthesis, PCR amplification, sequencing and V(D)J rearrangement analysis were conducted as previously described (11). Reported mutation frequency is calculated as frequency of nucleotide mutations in the V gene region of antibody sequence. CDRH3 lengths reported are defined as the number of residues after the invariant Cys in FR3 and before the invariant Trp in FR4.

Antibody Production

Immunoglobulin genes of mAbs DH270.1 through DH270.6, DH272 and DH475 were amplified from RNA from isolated cells, expression cassettes made, and mAbs expressed as described (12, 14). Inference of unmutated common ancestor (UCA) and intermediate antibodies DH270.IA1 through DH270.IA4 was conducted using methods previously described (36).

Heavy chain plasmids were co-transfected with appropriate light chain plasmids at an equal ratio in Expi 293 cells using ExpiFectamine 293 transfection reagents (Thermo Fisher Scientific) according to the manufacturer's protocols. We used the enhancer provided with the kit, transfected cultures were incubated at 37° C. 8% C02 for 2-6 days, harvested, concentrated and incubated overnight with Protein A beads at 4° C. on a rotating shaker before loading the bead mixture in columns for purification; following PBS/NaCl wash, eluate was neutralized with trizma hydrochloride and antibody concentration was determined by Nanodrop. Purified antibodies were tested in SDS-Page Coomassie and western blots, and stored at 4° C.

Next-Generation Sequencing

PBMC-extracted RNA from weeks 11, 19, 64, 111, 160, 186, and 240 post-infection were used to generate cDNA amplicons for next-generation sequencing (Illumina Miseq) as described previously (35). Briefly, RNA isolated from PBMCs was separated into two equal aliquots before cDNA production; cDNA amplification and NGS were performed on both aliquots as independent samples (denoted A and B). Reverse transcription (RT) was carried out using human IgG, IgA, IgM, IgK and IgX primers as previously described (12). After cDNA synthesis, IgG isotype IGHV1 and IGHV3 genes were amplified separately from weeks 11, 19, 64, 111, 160, and 186. IGHV1-IGHV6 genes were amplified at week 240. A second PCR step was performed to add Nextera index sequencing adapters (Illumina) and libraries were purified by gel extraction (Qiagen) and quantified by quantitative PCR using the KAPA SYBR FAST qPCR kit (KAPA Biosystems). Each replicate library was sequencing using the Illumina Miseq V3 2×300 bp kit.

NGS reads were computationally processed and analyzed as previously described (35). Briefly, forward and reverse reads were merged with FLASH with average read length and fragment read length parameters set to 450 and 300, respectively. Reads were quality filtered using FASTX (hannonlab.cshl.edu/fastx toolkit/) for sequences with a minimum of 50 percent of bases with a Phred quality score of 20 or greater (corresponding to 99% base call accuracy). Primer sequences were discarded and only unique nucleotide sequences were retained. To mitigate errors introduced during PCR amplification, reads detected in sample A and B with identical nucleotide VHDJH rearrangement sequences were delineated as replicated sequences. The total number of unique reads per sample and total number of replicated sequences ("Overlap") across samples for each time point is listed in FIG. 30. We used replicated sequences to define presence of antibody clonal lineages at any time-point.

We identified clonally-related sequences to DH270, DH272 and DH475 from the longitudinal NGS datasets by the following procedure. First, the CDR H3 of the probe-identified clonal parent sequence was BLASTed (E-value cutoff=0.01) against the pooled sample A and B sequence sets at each time point to get a candidate set of putative clonal members ("candidate set"). Next we identified replicated sequences across samples A and B in the candidate set. We then performed a clonal kinship test with the Cloanalyst software package (computationalimmunology/research/software/) as previously described (35) on replicated sequences. Clonally-related sequences within Sample A and B (including non-replicated sequences) were identified by performing the same clonal kinship test with Cloanalyst on the candidate set prior to identifying replicated sequences.

Clonal lineage reconstruction was performed on the NGS replicated sequences and probe-identified sequences of each clone using the Cloanalyst software package. A maximum of 100 sequences were used as input for inferring phylogenetic trees of clonal lineages. Clonal sequence sets were sub-sampled down to 100 sequences by collapsing to one sequence within a 2 or 9 base pair difference radius for the DH272 and DH270 clones, respectively.

The pre-vaccination NGS samples that were analyzed in FIG. 17A were obtained from HIV-1 uninfected participants of the HVTN082 and HVTN204 trials as previously described (35).

Sequence Analysis of Antibody Clonal Lineages

Unmutated common ancestors (UCA) and ancestral intermediate sequences were computationally inferred with the Cloanalyst software package. Cloanalyst uses Bayesian inference methods to infer the full unmutated V(D)J rearrangement thereby including a predicted unmutated CDR3 sequence. For lineage reconstructions when only cultured or sorted sequences were used as input, the heavy and light chain pairing relationship was retained during the inference of ancestral sequences. UCA inferences were performed each time a new member of the DH270 clonal lineage was experimentally isolated and thus several versions of the DH270 UCA were produced and tested. UCA1 and UCA3 were used for structural determination. UCA4 (referred to as DH270.UCA throughout the text), which was inferred using the most observed DH270 clonal members and had the lowest uncertainty of UCAs inferred (as quantified by the sum of the error probability over all base positions in the sequence), was used for binding and neutralization studies. Subsequently, the DH270 UCA was also re-inferred when NGS data became available. We applied a bootstrapping procedure to infer the UCA with the NGS data included, resampling clonal lineage trees 10 times with 100 input NGS sequences each. The UCA4 amino acid sequence was recapitulated by 7 out of 10 UCA inferences of the resampled NGS trees confirming support for UCA4.

Each inference of V(D)J calls is associated with a probability. The probability of the DH270 lineage to use the VH1-2 family gene was 99.99% and that of using allele 02 (VH1-2*02) was 98.26%. Therefore, there was a 0.01% probability that the family was incorrectly identified and a 1.74% probability that the allele was incorrectly identified. Therefore, we sequenced genomic DNA of individual CH848. As previously reported, positional conformity is defined as sharing a mutation at the same position in the V gene segment and identity conformity as sharing the same amino acid substitution at the same position (11).

We refer to the widely established AID hot and cold spots (respectively WRCY and SYC and their reverse-complements) as "canonical" and to other hot and cold spots defined by Yaari et al. as "non-canonical" (20, 37-39).

Sequencing of Germline Variable Region from Genomic DNA

Genomic DNA was isolated from donor CH848 from PBMCs 3 weeks after infection (QIAmp DNA Blood mini kit; Qiagen). IGVH1-2 and IGVL2-23 sequences were amplified using 2 independent primer sets by PCR. To ensure amplification of non-rearranged variable sequences, both primer sets reverse primers aligned to sequences present in the non-coding genomic DNA downstream the V-recombination site. The forward primer for set 1 resided in the IGVH1-2 and IGVL2-23 leader sequences and upstream of the leader in set 2. The PCR fragments were cloned into a pcDNA2.1 (TOPO-TA kit; Life technologies) and transformed into bacteria for sequencing of individual colonies. The following primers were used: VH1-2_1_S: tcctcttcttggtggcagcag (SEQ ID NO: 43); VH1-2_2_S: tacagatctgtcctgtgccct (SEQ ID NO: 44); VH1-2_1_tmAS: ttctcagccccagcacagctg (SEQ ID NO: 45); VH1-2_2_TmAS: gggtggcagagtgagactctgtcaca (SEQ ID NO: 46); VL2-23_2_S: agaggagcccaggatgctgat (SEQ ID NO: 47); VL2-23_1_S: actctcctcactcaggacaca (SEQ ID NO: 48); VL2-23_1_AS: tctcaaggccgcgctgcagca (SEQ ID NO: 49); VL2-23_2_AS: agctgtccctgtcctggatgg (SEQ ID NO: 50).

We identified two variants of VH1-2*02: the canonical sequence and a variant that encoded a VH that differed by 9 amino acids. Of these 9 amino acids, only 1 was shared among DH270 antibodies whereas 8 amino acids were not represented in DH270 lineage antibodies (FIG. 17B). The VH1-2*02 variant isolated from genomic DNA did not encode an arginine at position 57. We conclude that between the two variants of VH1-2*02 identified from genomic DNA from this individual, the DH270 lineage is likely derived from the canonical VH1-2*02 sequence.

Direct Binding ELISA

Direct-binding ELISAs were performed as described (11). Briefly, 384-well plates were blocked for 1 h at room temperature (RT) or overnight at 4° C. (both procedures were previously validated); primary purified antibodies were tested at a starting concentrations of 100 g/ml, serially three-fold diluted and incubated for 1 h at RT; HRP-conjugated human IgG antibody was added at optimized concentration of 1:30,000 in assay diluent for 1 hour and developed using TMB substrate; plates were read at 450 nm in a SpectraMax 384 PLUS reader (Molecular Devices, Sunnyvale, Calif.); results are reported as logarithm area under the curve (Log AUC) unless otherwise noted.

For biotinylated avi-tagged antigens, plates were coated with streptavidin (2 g/ml); blocked plates were stored at −20° C. until used and biotinylated avi-tagged antigens were added at 2 μg/ml for 30 minutes at RT.

Competition ELISAs were performed using 10 μl of primary purified monoclonal antibody, starting at 100 μg/ml and diluted in a two-fold concentration, incubated for 1 h at RT. Ten μl of biotinylated target Mab was added at the EC50 determined by a direct binding of biotinylated-Mab for one hour at RT. After background subtractions, percent inhibition was calculated as follows: 100-(test Ab triplicate mean/no inhibition control mean)*100.

Assessment of Virus Neutralization

Antibody and plasma neutralization was measured in TZM-bl cell-based assays. Neutralization breadth of DH270.1, DH270.5 and DH270.6 was assessed using the 384-well plate declination of the assay using an updated panel of 207 geographically and genetically diverse Env-pseudoviruses representing the major circulating genetic subtypes and recombinant forms as described (40). The data were calculated as a reduction in luminescence units compared with control wells, and reported as IC50 in μg/ml.

Single Genome Sequencing and Pseudovirus Production

3' half genome single genome sequencing of HIV-1 from longitudinally collected plasma was performed as previously described (41, 42). Sequence alignment was performed using ClustalW (version 2.11) and was adjusted manually using Geneious 8 (version 8.1.6). Env amino acid sequences were then aligned and evaluated for sites under selection using code derived from the Longitudinal Antigenic Sequences and Sites from Intra-host Evolution (LASSIE) tool (43). Using both LASSIE-based analysis and visual inspection, 100 representative env genes were selected for pseudovirus production. CMV promoter-ligated env genes were prepared and used to generate pseudotyped viruses as previously described (44).

Generation of Cell Surface-Expressed CH848 Env Trimer CHO Cell Line

The membrane-anchored CH848 TF Env trimer was expressed in CHO—S cells. Briefly, the CH848 env sequence was codon-optimized and cloned into an HIV-1-based lentiviral vector. A heterologous signal sequence from CD5 was inserted replacing that of the HIV-1 Env. The proteolytic cleavage site between gp120 and gp41 was altered, substituting serine residues for Arg508 and Arg511, the tyrosine at residues 712 was changed to alanine (Y712A), and the cytoplasmic tail was truncated by replacing the Lys808 codon with a sequence encoding (Gly)3 (His)6 (SEQ ID NO: 51) followed immediately by a TAA stop codon. This env-containing sequences was inserted into the vector immediately downstream of the tetracycline (tet)-responsive element (TRE), and upstream of an internal ribosome entry site (IRES) and a contiguous puromycin (puro)-T2A-EGFP open reading frame (generating K4831), as described previously for the JRFL and CH505 Envs (45).

CHO—S cells (Invitrogen) modified to constitutively express the reverse tet transactivator (rtTA) were transduced with packaged vesicular stomatitis virus (VSV) G glycoprotein-pseudotyped CH848 Env expression vector. Transduced cells were incubated in culture medium containing 1 μg/ml of doxycycline (dox) and selected for 7 days in medium supplemented with 25 μg/ml of puromycin, generating the Env expressor-population cell line termed D831. From D831, a stable, high-expressor clonal cell line was derived, termed D835. The integrity of the recombinant env sequence in the clonal cell lines was confirmed by direct (without cloning) sequence analysis of PCR amplicons.

Cell Surface-Expressed Trimeric CH848 Env Binding

D831 Selected TRE2.CH848.JF-8.IRS6A Chinese Hamster Ovary Cells were cultured in DMEM/F-12 supplemented with HEPES and L-glutamine (Thermo Fischer, Cat #11330057) 10% heat inactivated fetal bovine serum [FBS] (Thermo Fischer, Cat #10082147) and 1% Penicillin-Streptomycin (Thermo Fischer, Cat #15140163) and harvested when 70-80% confluent by trypsinization. A total 75,000 viable cells/well were transferred in 24-well tissue culture plates. After a 24-to-30-hour incubation at 37° C./5% CO2 in humidified atmosphere, CH848 Envs expression was induced with 1 g/mL doxycycline (Sigma-Aldrich, Cat # D9891) treatment for 16-20 hours. Cells were then washed in Stain buffer [PBS/2% FBS] and incubated at 4° C. for 30 minutes. Stain buffer was removed from cells and 0.2 ml/well of DH270 lineage antibodies, palivizumab (negative control) or PGT128 (positive control) were added at optimal concentration of 5 μg/mL for 30 minutes at 4° C. After a 2× wash, cells were stained with 40 ul of APC-conjugated mouse anti-Human IgG (BD Pharmigen, Cat #562025) per well (final volume 0.2 ml/well) for 30 minutes at 4° C. Unstained cells were used as further negative control. Cells were washed 3× and gently dissociated with 0.3 ml/well PBS/5 mM EDTA for 30 minutes at 4° C., transferred into 5 mL Polystyrene Round-Bottom Tubes (Falcon, Cat #352054), fixed with 0.1 mL of BD Cytofix/Cytoperm Fixation solution (BD Biosciences, Cat #554722) and kept on ice until analyzed using a BD LSRFortessa Cell Analyzer. Live cells were gated through Forward/Side Scatter exclusion, and then gated upon GFP+ and APC.

Oligomannose Arrays

Oligomannose arrays were printed with glycans at 100, 33, and 10 μM (Z Biotech). Arrays were blocked for 1 h in Hydrazide glycan blocking buffer. Monoclonal antibodies were diluted to 50 μg/mL in Hydrazide Glycan Assay Buffer, incubated on an individual subarray for 1 h, and then washed 5 times with PBS supplemented with 0.05% tween-20 (PBS-T). Subarrays that received biotinylated Concanavalin A were incubated with streptavidin-Cy3 (Sigma), whereas all other wells were incubated with anti-IgG-Cy3 (Sigma) for 1 h while rotating at 40 rpm covered from light. The arrays were washed 5 times with 70 μL of PBS-T and then washed once with 0.01×PBS. The washed arrays were spun dry and scanned with a GenePix 4000B (Molecular Devices) scanner at wavelength 532 nm using GenePix Pro7 software. The fluorescence within each feature was background subtracted using the local method in GenePix Pro7 software (Molecular Devices). To determine glycan specific binding, the local background corrected fluorescence of the print buffer alone was subtracted from each feature containing a glycan.

Synthesis of Man9-V3 Glycopeptide

A 30-amino acid V3 glycopeptide with oligomannose glycans (Man9-V3), based on the clade B JRFL mini-V3 construct (16), was chemically synthesized as described earlier (18). Briefly, after the synthesis of the oligomannose glycans in solution phase (18), two partially protected peptide fragments were obtained by Fmoc-based solid phase peptide synthesis, each featuring a single unprotected aspartate residue. The Man9GlcNAc2 anomeric amine was conjugated to each fragment (D301 or D332) using our one-flask aspartylation/deprotection protocol yielding the desired N-linked glycopeptide. These two peptide fragments were then joined by native chemical ligation immediately followed by cyclization via disulfide formation to afford Man9-V3-biotin. The control peptide, aglycone V3-biotin, had identical amino acid sequence as its glycosylated counterpart.

Affinity Measurements

Antibody binding kinetic rate constants (ka, kd) of the Man9-V3 glycopeptide and its aglycone form (16) were measured by Bio-layer Interferometry (BLI, ForteBio Octet Red96) measurements. The BLI assay was performed using streptavidin coated sensors (ForteBio) to capture either biotin-tagged Man9-V3 glycopeptide or Aglycone-V3 peptide. The V3 peptide immobilized sensors were dipped into varying concentrations of antibodies following blocking of sensors in BSA (0.1%). Antibody concentrations ranged from 0.5 to 150 μg/mL and non-specific binding interactions were subtracted using the control anti-RSV Palivizumab (Synagis) mAb. Rate constants were calculated by global curve fitting analyses to the Bivalent Avidity model of binding responses with a 10 min association and 15 min dissociation interaction time. The dissociation constant (Kd) values without avidity contribution were derived using the initial components of the association and dissociation rates (ka1 and kd1) respectively. Steady-state binding Kd values for binding to Man9-V3 glycopeptide with avidity contribution were derived using near steady-state binding responses at varying antibody concentrations (0.5-80 g/mL) and using a non-linear 4-parameter curve fitting analysis.

HIV-1 Env Site-Directed Mutagenesis

Deletion Mutant of CH0848.d0274.30.07 env gene was constructed using In Fusion HD EcoDry Cloning kit (Clontech) as per manufacturer instructions. Quick Change II Site-Directed Mutagenesis kit (Agilent Technologies) was used to introduce point mutations. All final env mutants were confirmed by sequencing.

Antibody Site-Directed Mutagenesis

Site-directed mutagenesis of antibody genes was performed using the Quikchange II lightening multi-site-directed mutagenesis kit following manufacturer's protocol (Agilent). Mutant plasmid products were confirmed by single-colony sequencing. Primers used for introducing mutations were: DH270_IA4_D31G: cccagtgtatatagtagccggtgaaggtgtatcca (SEQ ID NO: 52); DH270.IA4 I34M: tcgcacccagtgcatatagtagtcggtgaaggtgt (SEQ ID NO: 53); DH270.IA4 T55S: gatggatcaaccctaactctggtcgcacaaactat (SEQ ID NO: 54); DH270.IA4

R57G: tgtgcatagtttgtgccaccagtgttagggttgat (SEQ ID NO: 55); DH270.IA4 R57V: cttctgtgcatagtttgtgacaccagtgt-tagggttgatc (SEQ ID NO: 56); DH270.UCA G57R: atcaaccctaacagtggtcgcacaaactatgcaca (SEQ ID NO: 57).

Env Glycoprotein Expression

The codon-optimized CH848-derived env genes were generated by de novo synthesis (GeneScript, Piscataway, N.J.) or site-directed mutagenesis in mammalian expression plasmid pcDNA3.1/hygromycin (Invitrogen) as described (10), and stored at −80° C. until use.

Expression and Purification of DH270 Lineage Members for Crystallization Studies The heavy- and light-chain variable and constant domains of the DH270 lineage Fabs were cloned into the pVRC-8400 expression vector using Not1 and Nhe1 restriction sites and the tissue plasminogen activator signal sequence. The DH270.1 single chain variable fragment (scFv) was cloned into the same expression vector. The C terminus of the heavy-chain constructs and scFv contained a noncleavable 6× histidine tag (SEQ ID NO: 58). Site-directed mutagenesis was carried out, using manufacturer's protocols (Stratagene), to introduce mutations into the CDR regions of DH270.1. Fabs were expressed and purified as described previously (46). The DH270.1 scFv was purified the same way as the Fabs.

Crystallization, Structure Determination, and Refinement

All His-tagged Fabs and scFv were crystallized at 20-25 mg/mL. Crystals were grown in 96-well format using hanging drop vapor diffusion and appeared after 24-48 h at 20° C. Crystals were obtained in the following conditions: 2.5M ammonium sulfate and 100 mM sodium acetate, pH 5.0 for DH272; 1.5M ammonium sulfate and 100 mM sodium acetate pH 4.0 for UCA1; 20% PEG 4K, 100 mM sodium acetate, pH 5 and 100 mM magnesium sulfate for UCA3; 100 mM sodium acetate, pH 4.5, 200 mM lithium sulfate, and 2.5M NaCl for DH270.1; 1.4M lithium sulfate and 100 mM sodium acetate, pH 4.5 for DH270.3; 40% PEG 400 and 100 mM sodium citrate, pH 4.0 for DH270.5; and 30% PEG 4K, 100 mM PIPES pH 6, 1M NaCl for DH270.6. All crystals were harvested and cryoprotected by the addition of 20-25% glycerol to the reservoir solution and then flash-cooled in liquid nitrogen.

Diffraction data were obtained at 100 K from beam lines 24-ID-C and 24-ID-E at the Advanced Photon Source using a single wavelength. Datasets from individual crystals (multiple crystals for UCA1, DH270.1 and DH270.5) were processed with HKL2000. Molecular replacement calculations for the free Fabs were carried out with PHASER, using 13.2 from the CH103 lineage [Protein Data Bank (PDB) ID 4QHL] (46) or VRC01 from the VRC01/gp120 complex [Protein Data Bank (PDB) ID 4LST] (47) as the starting models. Subsequent structure determinations were performed using DH270 lineage members as search models. The Fab models were separated into their variable and constant domains for molecular replacement.

Refinement was carried out with PHENIX, and all model modifications were carried out with Coot. During refinement, maps were generated from combinations of positional, group B-factor, and TLS (translation/libration/screw) refinement algorithms. Secondary-structure restraints were included at all stages for all Fabs; noncrystallographic symmetry restraints were applied to the DH270.1 scFv and UCA3 Fab throughout refinement. The resulting electron density map for DH270.1 was further improved by solvent flattening, histogram matching, and non-crystallographic symmetry averaging using the program PARROT. Phase combination was disabled in these calculations. After density modification, restrained refinement was performed using Refmac in Coot. Structure validations were performed periodically during refinement using the MolProbity server. The final refinement statistics are summarized in FIG. 32.

Design of the 92BR SOSIP.664 Construct

To generate the clade B HIV-1 92BR SOSIP.664 expression construct we followed established SOSIP design parameters (48). Briefly, the 92BR SOSIP.664 trimer was engineered with a disulfide linkage between gp120 and gp41 by introducing A501C and T605C mutations (HxB2 numbering system) to covalently link the two subunits of the heterodimer (48). The I559P mutation was included in the heptad repeat region 1 (HR1) of gp41 for trimer stabilization, and part of the hydrophobic membrane proximal external region (MPER), in this case residues 664-681 of the Env ectodomain, was deleted (48). The furin cleavage site between gp120 and gp41 (508REKR511 (SEQ ID NO: 37)) was altered to 506RRRRRR511 (SEQ ID NO: 59) to enhance cleavage (48). The resulting, codon-optimized 92BR SOSIP.664 env gene was obtained from GenScript (Piscataway, N.J.) and cloned into pVRC-8400 as described above for Fabs using Nhe1 and NotI.

Purification of Envs for Analysis by Biolayer Interferometry and Negative Stain EM SOSIP.664 constructs were transfected along with a plasmid encoding the cellular protease furin at a 4:1 Env:furin ratio in HEK 293F cells. Site-directed mutagenesis was performed using manufacturer's protocols (Stratagene) for mutations in the V3 region and glycosylation sites. The cells were allowed to express soluble SOSIP.664 trimers for 5-7 days. Culture supernatants were collected and cells were removed by centrifugation at 3,800×g for 20 min, and filtered with a 0.2 μm pore size filter. SOSIP.664 proteins were purified by flowing the supernatant over a lectin (*Galanthus nivalis*) affinity chromatography column overnight at 4° C. The lectin column was washed with 1×PBS and proteins were eluted with 0.5M methyl-α-D-mannopyranoside and 0.5M NaCl. The eluate was concentrated and loaded onto a Superdex 200 10/300 GL column (GE Life Sciences) prequilibrated in a buffer of 10 mM Hepes, pH 8.0, 150 mM NaCl and 0.02% sodium azide for EM, or in 2.5 mM Tris, pH 7.5, 350 mM NaCl, 0.02% sodium azide for binding analysis, to separate the trimer-size oligomers from aggregates and gp140 monomers.

Electron Microscopy

Purified 92BR SOSIP.664 trimer was incubated with a five molar excess of DH270.1 Fab at 4° C. for 1 hour. A 3 μL aliquot containing ~0.01 mg/ml of the Fab—92BR SOSIP.664 complex was applied for 15 s onto a carbon coated 400 Cu mesh grid that had been glow discharged at 20 mA for 30s, followed by negative staining with 2% uranyl formate for 30 s. Samples were imaged using a FEI Tecnai T12 microscope operating at 120 kV, at a magnification of 52,000× that resulted in a pixel size of 2.13 Å at the specimen plane. Images were acquired with a Gatan 2K CCD camera using a nominal defocus of 1,500 nm at 100 tilt increments, up to 500. The tilts provided additional particle orientations to improve the image reconstructions.

Negative Stain Image Processing and 3D Reconstruction

Particles were picked semi-automatically using EMAN2 and put into a particle stack. Initial, reference-free, two-dimensional (2D) class averages were calculated and particles corresponding to complexes (with three Fabs bound) were selected into a substack for determination of an initial model. The initial model was calculated in EMAN2 using 3-fold symmetry and EMAN2 was used for subsequent refinement using 3-fold symmetry. In total, 5,419 particles were included in the final reconstruction for the 3D average of 92BR SOSIP.664 trimer complex with DH270.1. The resolution of the final model was determined using a Fourier Shell Correlation (FSC) cut-off of 0.5.

Model Fitting into the EM Reconstructions

The cryo-EM structure of PGT128-liganded BG505 SOSIP.664 (PDB ID: 5ACO) (28) and crystal structure of DH270.1 were manually fitted into the EM density and refined by using the UCSF Chimera 'Fit in map' function.

Biolayer Interferometry

Kinetic measurements of Fab binding to Envs were carried out using the Octet QKe system (ForteBio); 0.2 mg/mL of each His-tagged Fab was immobilized onto an anti-Human Fab-CH1 biosensor until it reached saturation. The SOSIP.664 trimers were tested at concentrations of 200 nM and 600 nM in duplicate. A reference sample of buffer alone was used to account for any signal drift that was observed during the experiment. Association and dissociation were each monitored for 5 min. All experiments were conducted in the Octet instrument at 30° C. in a buffer of 2.5 mM Tris, pH 7.5, 350 mM NaCl and 0.02% sodium azide with agitation at 1,000 rpm. Analyses were performed using nonlinear regression curve fitting using the Graphpad Prism software, version 6.

Protein Structure Analysis and Graphical Representations

The Fabs and their complexes analyzed in this study were superposed by least squares fitting in Coot. All graphical representations with protein crystal structures were made using PyMol.

Definition of Immunological Virus Phenotypes and Virus Signature Analysis

The maximum likelihood trees depicting the heterologous virus panel and the full set of Env sequences for the subject CH848 were created using the Los Alamos HIV database PhyML interface. HIV substitution models (49) were used and the proportion of invariable sites and the gamma parameters were estimated from the data. Illustrations were made using the Rainbow Tree interface that utilizes Ape. The analysis that coupled neutralization data with the within-subject phylogeny based on Envs that were evaluated for neutralization sensitivity was performed using LASSIE (43). Signature analysis was performed using the methods fully described in (50, 51).

Heat Maps and Logo Plots

Heat maps and logo plots were generated using the Los Alamos HIV database web interfaces (www.hiv.lanl.gov, version December 2015, HEATMAP and Analyze Align).

Selection of CH848 Env Signatures for Antibody Lineage Cooperation Studies.

We previously studied cooperation between lineages that occurred soon after infection, at a time when diversity in the autologous quasispecies was limited (12). In contrast, in CH848 the earliest autologous quasispecies transition in sensitivity to DH272/DH475 neutralization to DH270 lineage members occurred between week 39 and week 51, when multiple virus variants were circulating. Viral diversity made it impractical to test all the possible permutations or mutations from the transmitted founder virus. To select a smaller pool of candidate mutations, we sought the two most similar CH848 Env sequences at the amino acid level with opposite sensitivity to DH272/DH475 and DH270.1 neutralization around week 51 and identified clones CH0848.3.d0274.30.07 and CH0848.3.d0358.80.06 being the most similar (sim: 0.98713). Among the differences in amino acid sequences between these two clones, the four that we selected (Δ134-143 in V1); D185N in V2; N413Y in V4; Δ463-464 in V5) were the only ones consistently different among all clones with differential sensitivity to DH272 and DH270.1. We elected to use DH270.1 for these cooperating studies as the least mutated representative of DH270 antibodies that gained autologous neutralization at week 51. The D185N and N413Y mutations were also identified by the signature analysis shown in FIG. 19 and FIG. 36.

REFERENCES AND NOTES

1. D. R. Burton, J. R. Mascola, Antibody responses to envelope glycoproteins in HIV-1 infection. *Nature immunology* 16, 571-576 (2015).
2. J. R. Mascola, B. F. Haynes, HIV-1 neutralizing antibodies: understanding nature's pathways. *Immunological Reviews* 254, 225-244 (2013).
3. L. M. Walker, M. Huber, K. J. Doores, E. Falkowska, R. Pejchal, J. P. Julien, S. K. Wang, A. Ramos, P. Y. Chan-Hui, M. Moyle, J. L. Mitcham, P. W. Hammond, O. A. Olsen, P. Phung, S. Fling, C. H. Wong, S. Phogat, T. Wrin, M. D. Simek, W. C. Koff, I. A. Wilson, D. R. Burton, P. Poignard, Broad neutralization coverage of HIV by multiple highly potent antibodies. *Nature* 477, 466-470 (2011).
4. L. M. Walker, S. K. Phogat, P. Y. Chan-Hui, D. Wagner, P. Phung, J. L. Goss, T. Wrin, M. D. Simek, S. Fling, J. L. Mitcham, J. K. Lehrman, F. H. Priddy, O. A. Olsen, S. M. Frey, P. W. Hammond, S. Kaminsky, T. Zamb, M. Moyle, W. C. Koff, P. Poignard, D. R. Burton, Broad and potent neutralizing antibodies from an African donor reveal a new HIV-1 vaccine target. *Science* 326, 285-289 (2009).
5. K. J. Doores, L. Kong, S. A. Krumm, K. M. Le, D. Sok, U. Laserson, F. Garces, P. Poignard, I. A. Wilson, D. R. Burton, Two classes of broadly neutralizing antibodies within a single lineage directed to the high-mannose patch of HIV envelope. *Journal of virology* 89, 1105-1118 (2015).
6. D. Sok, K. J. Doores, B. Briney, K. M. Le, K. L. Saye-Francisco, A. Ramos, D. W. Kulp, J. P. Julien, S. Menis, L. Wickramasinghe, M. S. Seaman, W. R. Schief, I. A. Wilson, P. Poignard, D. R. Burton, Promiscuous glycan site recognition by antibodies to the high-mannose patch of gp120 broadens neutralization of HIV. *Science translational medicine* 6, 236ra263 (2014).
7. D. Sok, U. Laserson, J. Laserson, Y. Liu, F. Vigneault, J. P. Julien, B. Briney, A. Ramos, K. F. Saye, K. Le, A. Mahan, S. Wang, M. Kardar, G. Yaari, L. M. Walker, B. B. Simen, E. P. St John, P. Y. Chan-Hui, K. Swiderek, S. H. Kleinstein, G. Alter, M. S. Seaman, A. K. Chakraborty, D. Koller, I. A. Wilson, G. M. Church, D. R. Burton, P. Poignard, The effects of somatic hypermutation on neutralization and binding in the PGT121 family of broadly neutralizing HIV antibodies. *PLoS pathogens* 9, e1003754 (2013).
8. H. Mouquet, L. Scharf, Z. Euler, Y. Liu, C. Eden, J. F. Scheid, A. Halper-Stromberg, P. N. Gnanapragasam, D. I. Spencer, M. S. Seaman, H. Schuitemaker, T. Feizi, M. C. Nussenzweig, P. J. Bjorkman, Complex-type N-glycan recognition by potent broadly neutralizing HIV antibodies. *Proceedings of the National Academy of Sciences of the United States of America* 109, E3268-3277 (2012).
9. B. F. Haynes, G. Kelsoe, S. C. Harrison, T. B. Kepler, B-cell-lineage immunogen design in vaccine development with HIV-1 as a case study. *Nature Biotechnology* 30, 423-433 (2012).
10. H. X. Liao, R. Lynch, T. Zhou, F. Gao, S. M. Alam, S. D. Boyd, A. Z. Fire, K. M. Roskin, C. A. Schramm, Z.

Zhang, J. Zhu, L. Shapiro, J. C. Mullikin, S. Gnanakaran, P. Hraber, K. Wiehe, G. Kelsoe, G. Yang, S. M. Xia, D. C. Montefiori, R. Parks, K. E. Lloyd, R. M. Scearce, K. A. Soderberg, M. Cohen, G. Kamanga, M. K. Louder, L. M. Tran, Y. Chen, F. Cai, S. Chen, S. Moquin, X. Du, M. G. Joyce, S. Srivatsan, B. Zhang, A. Zheng, G. M. Shaw, B. H. Hahn, T. B. Kepler, B. T. Korber, P. D. Kwong, J. R. Mascola, B. F. Haynes, Co-evolution of a broadly neutralizing HIV-1 antibody and founder virus. *Nature* 496, 469-476 (2013).

11. M. Bonsignori, T. Zhou, Z. Sheng, L. Chen, F. Gao, M. G. Joyce, G. Ozorowski, G. Y. Chuang, C. A. Schramm, K. Wiehe, S. M. Alam, T. Bradley, M. A. Gladden, K. K. Hwang, S. Iyengar, A. Kumar, X. Lu, K. Luo, M. C. Mangiapani, R. J. Parks, H. Song, P. Acharya, R. T. Bailer, A. Cao, A. Druz, I. S. Georgiev, Y. D. Kwon, M. K. Louder, B. Zhang, A. Zheng, B. J. Hill, R. Kong, C. Soto, J. C. Mullikin, D. C. Douek, D. C. Montefiori, M. A. Moody, G. M. Shaw, B. H. Hahn, G. Kelsoe, P. T. Hraber, B. T. Korber, S. D. Boyd, A. Z. Fire, T. B. Kepler, L. Shapiro, A. B. Ward, J. R. Mascola, H. X. Liao, P. D. Kwong, B. F. Haynes, Maturation Pathway from Germline to Broad HIV-1 Neutralizer of a CD4-Mimic Antibody. *Cell* 165, 449-463 (2016).
12. F. Gao, M. Bonsignori, H. X. Liao, A. Kumar, S. M. Xia, X. Lu, F. Cai, K. K. Hwang, H. Song, T. Zhou, R. M. Lynch, S. M. Alam, M. A. Moody, G. Ferrari, M. Berrong, G. Kelsoe, G. M. Shaw, B. H. Hahn, D. C. Montefiori, G. Kamanga, M. S. Cohen, P. Hraber, P. D. Kwong, B. T. Korber, J. R. Mascola, T. B. Kepler, B. F. Haynes, Cooperation of B cell lineages in induction of HIV-1-broadly neutralizing antibodies. *Cell* 158, 481-491 (2014).
13. M. Pancera, T. Zhou, A. Druz, I. S. Georgiev, C. Soto, J. Gorman, J. Huang, P. Acharya, G. Y. Chuang, G. Ofek, G. B. Stewart-Jones, J. Stuckey, R. T. Bailer, M. G. Joyce, M. K. Louder, N. Tumba, Y. Yang, B. Zhang, M. S. Cohen, B. F. Haynes, J. R. Mascola, L. Morris, J. B. Munro, S. C. Blanchard, W. Mothes, M. Connors, P. D. Kwong, Structure and immune recognition of trimeric pre-fusion HIV-1 Env. *Nature* 514, 455-461 (2014).
14. M. Bonsignori, K. K. Hwang, X. Chen, C. Y. Tsao, L. Morris, E. Gray, D. J. Marshall, J. A. Crump, S. H. Kapiga, N. E. Sam, F. Sinangil, M. Pancera, Y. Yongping, B. Zhang, J. Zhu, P. D. Kwong, S. O'Dell, J. R. Mascola, L. Wu, G. J. Nabel, S. Phogat, M. S. Seaman, J. F. Whitesides, M. A. Moody, G. Kelsoe, X. Yang, J. Sodroski, G. M. Shaw, D. C. Montefiori, T. B. Kepler, G. D. Tomaras, S. M. Alam, H. X. Liao, B. F. Haynes, Analysis of a clonal lineage of HIV-1 envelope V2/V3 conformational epitope-specific broadly neutralizing antibodies and their inferred unmutated common ancestors. *Journal of virology* 85, 9998-10009 (2011).
15. E. S. Gray, M. A. Moody, C. K. Wibmer, X. Chen, D. Marshall, J. Amos, P. L. Moore, A. Foulger, J. S. Yu, B. Lambson, S. Abdool Karim, J. Whitesides, G. D. Tomaras, B. F. Haynes, L. Morris, H. X. Liao, Isolation of a monoclonal antibody that targets the alpha-2 helix of gp120 and represents the initial autologous neutralizing-antibody response in an HIV-1 subtype C-infected individual. *Journal of virology* 85, 7719-7729 (2011).
16. S. M. Alam, B. Aussedat, Y. Vohra, R. R. Meyerhoff, E. M. Cale, W. E. Walkowicz, N. A. Radakovich, L. Armand, R. Parks, L. Sutherland, R. Scearce, M. G. Joyce, M. Pancera, A. Druz, I. Georgiev, T. Von Holle, A. Eaton, C. Fox, S. G. Reed, M. K. Louder, R. T. Bailer, L. Morris, S. Abdool Karim, M. Cohen, H. X. Liao, D. Montefiori, P. K. Park, A. Femandez-Tejada, K. Wiehe, S. Santra, T. B. Kepler, K. O. Saunders, J. Sodroski, P. D. Kwong, J. R. Mascola, M. Bonsignori, M. A. Moody, S. J. Danishefsky, B. F. Haynes, Mimicry of an HIV broadly neutralizing antibody epitope with a synthetic glycopeptide. *under review.*
17. R. Pejchal, K. J. Doores, L. M. Walker, R. Khayat, P. S. Huang, S. K. Wang, R. L. Stanfield, J. P. Julien, A. Ramos, M. Crispin, R. Depetris, U. Katpally, A. Marozsan, A. Cupo, S. Maloveste, Y. Liu, R. McBride, Y. Ito, R. W. Sanders, C. Ogohara, J. C. Paulson, T. Feizi, C. N. Scanlan, C. H. Wong, J. P. Moore, W. C. Olson, A. B. Ward, P. Poignard, W. R. Schief, D. R. Burton, I. A. Wilson, A potent and broad neutralizing antibody recognizes and penetrates the HIV glycan shield. *Science* 334, 1097-1103 (2011).
18. B. Aussedat, Y. Vohra, P. K. Park, A. Femandez-Tejada, S. M. Alam, S. M. Dennison, F. H. Jaeger, K. Anasti, S. Stewart, J. H. Blinn, H. X. Liao, J. G. Sodroski, B. F. Haynes, S. J. Danishefsky, Chemical synthesis of highly congested gp120 V1V2 N-glycopeptide antigens for potential HIV-1-directed vaccines. *Journal of the American Chemical Society* 135, 13113-13120 (2013).
19. S. M. Alam, S. M. Dennison, B. Aussedat, Y. Vohra, P. K. Park, A. Femandez-Tejada, S. Stewart, F. H. Jaeger, K. Anasti, J. H. Blinn, T. B. Kepler, M. Bonsignori, H. X. Liao, J. G. Sodroski, S. J. Danishefsky, B. F. Haynes, Recognition of synthetic glycopeptides by HIV-1 broadly neutralizing antibodies and their unmutated ancestors. *Proc Natl Acad Sci USA* 110, 18214-18219 (2013).
20. G. Yaari, J. A. Vander Heiden, M. Uduman, D. Gadala-Maria, N. Gupta, J. N. Stem, K. C. O'Connor, D. A. Hafler, U. Laserson, F. Vigneault, S. H. Kleinstein, Models of somatic hypermutation targeting and substitution based on synonymous mutations from high-throughput immunoglobulin sequencing data. *Frontiers in immunology* 4, 358 (2013).
21. We accessed the SF5 mutability model dataset at clip.med.yale.edu/shm/download.php.
22. L. Kong, J. H. Lee, K. J. Doores, C. D. Murin, J. P. Julien, R. McBride, Y. Liu, A. Marozsan, A. Cupo, P. J. Klasse, S. Hoffenberg, M. Caulfield, C. R. King, Y. Hua, K. M. Le, R. Khayat, M. C. Deller, T. Clayton, H. Tien, T. Feizi, R. W. Sanders, J. C. Paulson, J. P. Moore, R. L. Stanfield, D. R. Burton, A. B. Ward, I. A. Wilson, Supersite of immune vulnerability on the glycosylated face of HIV-1 envelope glycoprotein gp120. *Nature structural & molecular biology* 20, 796-803 (2013).
23. J. P. Julien, D. Sok, R. Khayat, J. H. Lee, K. J. Doores, L. M. Walker, A. Ramos, D. C. Diwanji, R. Pejchal, A. Cupo, U. Katpally, R. S. Depetris, R. L. Stanfield, R. McBride, A. J. Marozsan, J. C. Paulson, R. W. Sanders, J. P. Moore, D. R. Burton, P. Poignard, A. B. Ward, I. A. Wilson, Broadly neutralizing antibody PGT121 allosterically modulates CD4 binding via recognition of the HIV-1 gp120 V3 base and multiple surrounding glycans. *PLoS pathogens* 9, e1003342 (2013).
24. M. Pancera, Y. Yang, M. K. Louder, J. Gorman, G. Lu, J. S. McLellan, J. Stuckey, J. Zhu, D. R. Burton, W. C. Koff, J. R. Mascola, P. D. Kwong, N332-Directed broadly neutralizing antibodies use diverse modes of HIV-1 recognition: inferences from heavy-light chain complementation of function. *PloS one* 8, e55701 (2013).
25. P. L. Moore, E. S. Gray, C. K. Wibmer, J. N. Bhiman, M. Nonyane, D. J. Sheward, T. Hermanus, S. Bajimaya, N. L. Tumba, M. R. Abrahams, B. E. Lambson, N. Ranchobe, L. Ping, N. Ngandu, Q. Abdool Karim, S. S. Abdool Karim, R. I. Swanstrom, M. S. Seaman, C. Williamson, L. Morris, Evolution of an HIV glycan-dependent broadly neutralizing antibody epitope through immune escape. *Nature medicine* 18, 1688-1692 (2012).
26. LANL HIV Sequence Database (hiv.lanl.gov/content/sequence/HIV/mainpage.html)
27. F. Garces, D. Sok, L. Kong, R. McBride, H. J. Kim, K. F. Saye-Francisco, J. P. Julien, Y. Hua, A. Cupo, J. P. Moore, J. C. Paulson, A. B. Ward, D. R. Burton, I. A. Wilson, Structural evolution of glycan recognition by a family of potent HIV antibodies. *Cell* 159, 69-79 (2014).
28. J. H. Lee, N. de Val, D. Lyumkis, A. B. Ward, Model Building and Refinement of a Natively Glycosylated HIV-1 Env Protein by High-Resolution Cryoelectron Microscopy. Structure 23, 1943-1951 (2015).
29. F. Garces, J. H. Lee, N. de Val, A. T. de la Pena, L. Kong, C. Puchades, Y. Hua, R. L. Stanfield, D. R. Burton, J. P. Moore, R. W. Sanders, A. B. Ward, I. A. Wilson, Affinity Maturation of a Potent Family of HIV Antibodies Is Primarily Focused on Accommodating or Avoiding Glycans. *Immunity* 43, 1053-1063 (2015).
30. M. Bonsignori, D. C. Montefiori, X. Wu, X. Chen, K. K. Hwang, C. Y. Tsao, D. M. Kozink, R. J. Parks, G. D. Tomaras, J. A. Crump, S. H. Kapiga, N. E. Sam, P. D. Kwong, T. B. Kepler, H. X. Liao, J. R. Mascola, B. F. Haynes, Two distinct broadly neutralizing antibody specificities of different clonal lineages in a single HIV-1-infected donor: implications for vaccine design. *Journal of virology* 86, 4688-4692 (2012).
31. K. Wagh, T. Bhattacharya, C. Williamson, A. Robles, M. Bayne, J. Garrity, M. Rist, C. Rademeyer, H. Yoon, A. Lapedes, H. Gao, K. Greene, M. K. Louder, R. Kong, S. A. Karim, D. R. Burton, D. H. Barouch, M. C. Nussenzweig, J. R. Mascola, L. Morris, D. C. Montefiori, B. Korber, M. S. Seaman, Optimal Combinations of Broadly Neutralizing Antibodies for Prevention and Treatment of HIV-1 Clade C Infection. *PLoS pathogens* 12, e1005520 (2016).
32. L. S. Yeap, J. K. Hwang, Z. Du, R. M. Meyers, F. L. Meng, A. Jakubauskaite, M. Liu, V. Mani, D. Neuberg, T. B. Kepler, J. H. Wang, F. W. Alt, Sequence-Intrinsic Mechanisms that Target AID Mutational Outcomes on Antibody Genes. *Cell* 163, 1124-1137 (2015).
33. G. D. Tomaras, N. L. Yates, P. Liu, L. Qin, G. G. Fouda, L. L. Chavez, A. C. Decamp, R. J. Parks, V. C. Ashley, J. T. Lucas, M. Cohen, J. Eron, C. B. Hicks, H. X. Liao, S. G. Self, G. Landucci, D. N. Forthal, K. J. Weinhold, B. F. Keele, B. H. Hahn, M. L. Greenberg, L. Morris, S. S. Karim, W. A. Blattner, D. C. Montefiori, G. M. Shaw, A. S. Perelson, B. F. Haynes, Initial B-cell responses to transmitted human immunodeficiency virus type 1: virion-binding immunoglobulin M (IgM) and IgG antibodies followed by plasma anti-gp41 antibodies with ineffective control of initial viremia. *Journal of virology* 82, 12449-12463 (2008).
34. G. M. Shaw, E. Hunter, HIV transmission. *Cold Spring Harbor perspectives in medicine* 2, (2012).
35. W. B. Williams, H. X. Liao, M. A. Moody, T. B. Kepler, S. M. Alam, F. Gao, K. Wiehe, A. M. Trama, K. Jones, R. Zhang, H. Song, D. J. Marshall, J. F. Whitesides, K. Sawatzki, A. Hua, P. Liu, M. Z. Tay, K. E. Seaton, X. Shen, A. Foulger, K. E. Lloyd, R. Parks, J. Pollara, G. Ferrari, J. S. Yu, N. Vandergrift, D. C. Montefiori, M. E. Sobieszczyk, S. Hammer, S. Karuna, P. Gilbert, D. Grove, N. Grunenberg, M. J. McElrath, J. R. Mascola, R. A. Koup, L. Corey, G. J. Nabel, C. Morgan, G. Churchyard, J. Maenza, M. Keefer, B. S. Graham, L. R. Baden, G. D. Tomaras, B. F. Haynes, HIV-1 VACCINES. Diversion of HIV-1 vaccine-induced immunity by gp41-microbiota cross-reactive antibodies. *Science* 349, aab1253 (2015).
36. T. B. Kepler, Reconstructing a B-cell clonal lineage. I. Statistical inference of unobserved ancestors. *F*1000*Res* 2, 103 (2013).
37. L. G. Cowell, T. B. Kepler, The nucleotide-replacement spectrum under somatic hypermutation exhibits microsequence dependence that is strand-symmetric and distinct from that under germline mutation. *Journal of Immunology* 164, 1971-1976 (2000).
38. A. G. Betz, C. Rada, R. Pannell, C. Milstein, M. S. Neuberger, Passenger transgenes reveal intrinsic specificity of the antibody hypermutation mechanism: clustering, polarity, and specific hot spots. *Proceedings of the National Academy of Sciences of the United States of America* 90, 2385-2388 (1993).
39. R. Bransteitter, P. Pham, P. Calabrese, M. F. Goodman, Biochemical analysis of hypermutational targeting by wild type and mutant activation-induced cytidine deaminase. *The Journal of biological chemistry* 279, 51612-51621 (2004).
40. M. S. Seaman, H. Janes, N. Hawkins, L. E. Grandpre, C. Devoy, A. Giri, R. T. Coffey, L. Harris, B. Wood, M. G. Daniels, T. Bhattacharya, A. Lapedes, V. R. Polonis, F. E. McCutchan, P. B. Gilbert, S. G. Self, B. T. Korber, D. C. Montefiori, J. R. Mascola, Tiered categorization of a diverse panel of HIV-1 Env pseudoviruses for assessment of neutralizing antibodies. *Journal of virology* 84, 1439-1452 (2010).
41. J. F. Salazar-Gonzalez, M. G. Salazar, B. F. Keele, G. H. Learn, E. E. Giorgi, H. Li, J. M. Decker, S. Wang, J. Baalwa, M. H. Kraus, N. F. Parrish, K. S. Shaw, M. B. Guffey, K. J. Bar, K. L. Davis, C. Ochsenbauer-Jambor, J. C. Kappes, M. S. Saag, M. S. Cohen, J. Mulenga, C. A. Derdeyn, S. Allen, E. Hunter, M. Markowitz, P. Hraber, A. S. Perelson, T. Bhattacharya, B. F. Haynes, B. T. Korber, B. H. Hahn, G. M. Shaw, Genetic identity, biological phenotype, and evolutionary pathways of transmitted/founder viruses in acute and early HIV-1 infection. *The Journal of experimental medicine* 206, 1273-1289 (2009).
42. B. F. Keele, E. E. Giorgi, J. F. Salazar-Gonzalez, J. M. Decker, K. T. Pham, M. G. Salazar, C. Sun, T. Grayson, S. Wang, H. Li, X. Wei, C. Jiang, J. L. Kirchherr, F. Gao, J. A. Anderson, L. H. Ping, R. Swanstrom, G. D. Tomaras, W. A. Blattner, P. A. Goepfert, J. M. Kilby, M. S. Saag, E. L. Delwart, M. P. Busch, M. S. Cohen, D. C. Montefiori, B. F. Haynes, B. Gaschen, G. S. Athreya, H. Y. Lee, N. Wood, C. Seoighe, A. S. Perelson, T. Bhattacharya, B. T. Korber, B. H. Hahn, G. M. Shaw, Identification and characterization of transmitted and early founder virus envelopes in primary HIV-1 infection. *Proceedings of the National Academy of Sciences of the United States of America* 105, 7552-7557 (2008).
43. P. Hraber, B. Korber, K. Wagh, E. E. Giorgi, T. Bhattacharya, S. Gnanakaran, A. S. Lapedes, G. H. Learn, E. F. Kreider, Y. Li, G. M. Shaw, B. H. Hahn, D. C. Montefiori, S. M. Alam, M. Bonsignori, M. A. Moody, H. X. Liao, F. Gao, B. F. Haynes, Longitudinal Antigenic Sequences and Sites from Intra-Host Evolution (LASSIE) Identifies Immune-Selected HIV Variants. *Viruses* 7, 5443-5475 (2015).
44. J. L. Kirchherr, X. Lu, W. Kasongo, V. Chalwe, L. Mwananyanda, R. M. Musonda, S. M. Xia, R. M. Scearce, H. X. Liao, D. C. Montefiori, B. F. Haynes, F.

Gao, High throughput functional analysis of HIV-1 env genes without cloning. *Journal of virological methods* 143, 104-111 (2007).

45. E. P. Go, A. Herschhom, C. Gu, L. Castillo-Menendez, S. Zhang, Y. Mao, H. Chen, H. Ding, J. K. Wakefield, D. Hua, H. X. Liao, J. C. Kappes, J. Sodroski, H. Desaire, Comparative Analysis of the Glycosylation Profiles of Membrane-Anchored HIV-1 Envelope Glycoprotein Trimers and Soluble gp140. *Journal of virology* 89, 8245-8257 (2015).
46. D. Fera, A. G. Schmidt, B. F. Haynes, F. Gao, H. X. Liao, T. B. Kepler, S. C. Harrison, Affinity maturation in an HIV broadly neutralizing B-cell lineage through reorientation of variable domains. *Proceedings of the National Academy of Sciences of the United States of America* 111, 10275-10280 (2014).
47. T. Zhou, J. Zhu, X. Wu, S. Moquin, B. Zhang, P. Acharya, I. S. Georgiev, H. R. Altae-Tran, G. Y. Chuang, M. G. Joyce, Y. D. Kwon, N. S. Longo, M. K. Louder, T. Luongo, K. McKee, C. A. Schramm, J. Skinner, Y. Yang, Z. Yang, Z. Zhang, A. Zheng, M. Bonsignori, B. F. Haynes, J. F. Scheid, M. C. Nussenzweig, M. Simek, D. R. Burton, W. C. Koff, J. C. Mullikin, M. Connors, L. Shapiro, G. J. Nabel, J. R. Mascola, P. D. Kwong, Multidonor analysis reveals structural elements, genetic determinants, and maturation pathway for HIV-1 neutralization by VRC01-class antibodies. *Immunity* 39, 245-258 (2013).
48. R. W. Sanders, R. Derking, A. Cupo, J. P. Julien, A. Yasmeen, N. de Val, H. J. Kim, C. Blattner, A. T. de la Pena, J. Korzun, M. Golabek, K. de Los Reyes, T. J. Ketas, M. J. van Gils, C. R. King, I. A. Wilson, A. B. Ward, P. J. Klasse, J. P. Moore, A next-generation cleaved, soluble HIV-1 Env trimer, BG505 SOSIP.664 gp140, expresses multiple epitopes for broadly neutralizing but not non-neutralizing antibodies. *PLoS pathogens* 9, e1003618 (2013).
49. D. C. Nickle, L. Heath, M. A. Jensen, P. B. Gilbert, J. I. Mullins, S. L. Kosakovsky Pond, HIV-specific probabilistic models of protein evolution. *PloS one* 2, e503 (2007).
50. S. Gnanakaran, M. G. Daniels, T. Bhattacharya, A. S. Lapedes, A. Sethi, M. Li, H. Tang, K. Greene, H. Gao, B. F. Haynes, M. S. Cohen, G. M. Shaw, M. S. Seaman, A. Kumar, F. Gao, D. C. Montefiori, B. Korber, Genetic signatures in the envelope glycoproteins of HIV-1 that associate with broadly neutralizing antibodies. *PLoS computational biology* 6, e1000955 (2010).
51. T. Bhattacharya, M. Daniels, D. Heckerman, B. Foley, N. Frahm, C. Kadie, J. Carlson, K. Yusim, B. McMahon, B. Gaschen, S. Mallal, J. I. Mullins, D. C. Nickle, J. Herbeck, C. Rousseau, G. H. Learn, T. Miura, C. Brander, B. Walker, B. Korber, Founder effects in the assessment of HIV polymorphisms and HLA allele associations. *Science* 315, 1583-1586 (2007).
52. L. Kong, A. Torrents de la Pena, M. C. Deller, F. Garces, K. Sliepen, Y. Hua, R. L. Stanfield, R. W. Sanders, I. A. Wilson, Complete epitopes for vaccine design derived from a crystal structure of the broadly neutralizing antibodies PGT128 and 8ANC195 in complex with an HIV-1 Env trimer. *Acta crystallographica. Section D, Biological crystallography* 71, 2099-2108 (2015).

Data and Materials Availability.

The V(D)J rearrangement sequences of DH272, DH475 and the DH270 lineage antibodies (DH270.UCA, DH270.IA1 through IA4, and DH270.1 through 6) have been deposited in GenBank with accession numbers KY354938 through KY354963. NGS sequence data for clones DH270, DH272 and DH475 have been deposited in GenBank with accession numbers KY347498 through KY347701. Coordinates and structure factors for UCA1, UCA3, DH270.1, DH270.3, DH270.5, DH270.6, and DH272 have been deposited in the Protein Data Bank with accession code 5U0R, 5U15, 5U0U, 5TPL, 5TPP, 5TQA, and 5TRP, respectively. The EM map of the 92BR SOSIP.664 trimer in complex with DH270.1 has been deposited in the EM Data Bank with accession code EMD-8507.

Example 2 $Man_9$-V3 Glycopeptides and Aglycone Peptides

This example provides non-limiting embodiments of V3 peptides which can be used in the immunogenic compositions and methods.

The crystal structure of the HIV-1 V3 bnAb PGT128 in complex with gp120 outer domain containing a truncated V3 loop revealed the key antibody contacts with its glycosylated epitope (R. Pejchal et al., Science (New York, N.Y.) 334, 1097 (2011)). We constructed a glycosylated peptide ($Man_9$-V3) that is comprised of the discontinuous epitope of PGT128 with deletion of residues 305-320, retention of $P^{321}$, and stabilization by a disulfide bridge between $C^{296}$ and $C^{331}$ (FIG. 38A-E) (R. Pejchal et al., Science (New York, N.Y.) 334, 1097 (2011)). $Man_9$-V3 glycopeptide was synthesized using a similar synthetic approach used to produce V1V2 glycopeptides (B. Aussedat et al., *J Am Chem Soc* 135, 13113 (2013)). As controls, a biotinylated aglycone-V3 peptide with no high mannose glycans (FIG. 38C) and a biotinylated $Man_9$ free glycan (FIG. 38A) were also synthesized.

V3-Glycan bnAb DH270 Unmutated Common Ancestor Binding to the Peptide Component of $Man_9$-V3 Glycopeptide The unmutated common ancestor (UCA) and the earlier intermediates in the DH270 lineage showed no detectable binding to either soluble or to cell surface Env. However, the DH270 bnAb UCA did bind to $Man_9$V3 (FIG. 27A) and, as well, bound to the aglycone-V3 (FIG. 27B). Similarly, the early intermediate antibodies (IA4, IA3, IA2) each bound to both $Man_9$V3 and aglycone-V3, and their binding was stronger to the aglycone-V3 compared to the $Man_9$-V3glycopeptide (FIG. 27B). Binding to the $Man_9$-V3 glycopeptide remained low (>10 M) up to the DH270.1 bnAb lineage member (FIG. 27A), when the affinity increased (coincident with nucleotide mutations up to a frequency of 5.6%) to a $K_d$ of 331 nM with better binding to the glycopeptide than to aglycone-V3 (FIGS. 27A-B). Thereafter in the DH270 bnAb lineage as mutations accumulated, binding to the $Man_9$-V3 glycopeptide increased, culminating in a $K_d$ of 188 nM in the most potent bnAb, DH270.6, and no binding to aglycone-V3 peptide (FIGS. 27A-B). Thus, both the $Man_9$-V3 glycopeptide and the aglycone-V3 peptide bound the DH270.UCA with the lineage member binding independent of glycans until the DH270 lineage acquired a frequency of ~6% nucleotide mutations.

Additional V3 peptides contemplated by the invention are listed in Table 2. Table 2 below includes non-limiting examples of V3 peptides

| | |
|---|---|
| CH848.TF_V3_293-321-biotin | EIVCTRPGNNTRKSVRIGPGQTFYATGK |
| CH848.TF_V3_297-324-biotin | TRPGNNTRKSVRIGPGQTFYATGDIIGK |
| CH848.TF_V3_303-330-biotin | TRKSVRIGPGQTFYATGDIIGDIRQAHK |
| CH848.TF_V3_307-334-biotin | VRIGPGQTFYATGDIIGDIRQAHCNISK |
| CH848.TF_V3_315-340-biotin | QTFYATGDIIGDIRQAHCNISERQWNKK |
| CH848.TF_V3_biotin-315-340 | KQTFYATGDIIGDIRQAHCNISERQWNK |
| CH848.0949.10.17_V3_293-321-biotin | EIVCTRPNNNTRKSVRIGPGQTFYATGK |
| CH848.0949.10.17_V3_297-324-biotin | TRPNNNTRKSVRIGPGQTFYATGDIIGK |
| CH848.0949.10.17_V3_303-330-biotin | TRKSVRIGPGQTFYATGDIIGDIKQAHK |
| CH848.0949.10.17_V3_307-334-biotin | VRIGPGQTFYATGDIIGDIKQAHCNISK |
| CH848.0949.10.17_V3_315-340-biotin | QTFYATGDIIGDIKQAHCNISEEKWNDK |
| CH848.0949.10.17_V3_biotin-315-340 | KQTFYATGDIIGDIKQAHCNISEEKWND |

Peptide sequences above in order of appearance in Table 2 are SEQ ID Nos: 2 to 13. Peptides sequence from Table 2 without N- or C-terminal biotinylation lysine are SEQ ID NOs: 14 to 25.

Any of the peptides could be biotinylated. In some embodiments, the peptides are biotinylated on the C terminus, except CH848.TF V3 biotin-315-340 and CH848.0949.10.17 V3 biotin-315-340, which are biotinylated on the N terminus.

The peptides of the invention can be synthesized by any known method. V3 aglycone of and $Man_9V3$ and their synthesis are provided in FIG. 38A. See also WO2014/172366.

In some embodiments, the peptides are:

CH848.TF_V3_293-321-biotin (SEQ ID NO: 2)
EIVCTRPGNNTRKSVRIGPGQTFYATGK-Biotin

CH848.TF_V3_297-324-biotin (SEQ ID NO: 3)
TRPGNNTRKSVRIGPGQTFYATGDIIGK-Biotin

CH848.TF_V3_303-330-biotin (SEQ ID NO: 4)
TRKSVRIGPGQTFYATGDIIGDIRQAHK-Biotin

CH848.TF_V3_307-334-biotin (SEQ ID NO: 5)
VRIGPGQTFYATGDIIGDIRQAHCNISK-Biotin

CH848.TF_V3_315-340-biotin (SEQ ID NO: 6)
QTFYATGDIIGDIRQAHCNISERQWNKK-Biotin

It is readily understood that peptides which are not biotinylated do not include an N- or C-terminal lysine (or other specific functional groups or residues) for targeting with biotynalation reagents.

V3 (+the base containing N332 NGS) of CH848 transmitted founder and CH0848.0949.10.17 are shown below:

TF EIVCTRPGNNTRKSVRIGPGQTFYATGDIIGDIRQAHCNISERQWNK (SEQ ID NO: 26 with lysine and SEQ ID NO: 27 without terminal lysine).

CH0848.0949.10.17 (SEQ ID NO: 28)
EIVCTRPNNNTRKSVRIGPGQTFYATGDIIGDIKQAHCNISEEKWND.

Non-limiting embodiments of V3 peptides variants include:

a. Wildtype (SEQ ID NO: 29)
EINCTRPNNNTRPGEIIGDIRQAHCNISRA b. GAIA (SEQ ID NO: 510): (SEQ ID NO: 30)
EINCTRPNNNTRPGEIIGAIAQAHCNISRA c. GDIA (SEQ ID NO: 511): (SEQ ID NO: 31)
EINCTRPNNNTRPGEIIGDIRQAHCNISRA d. GAIR (SEQ ID NO: 512): (SEQ ID NO: 32)
EINCTRPNNNTRPGEIIGAIRQAHCNISRA e. ADAR (SEQ ID NO: 513): (SEQ ID NO: 33)
EINCTRPNNNTRPGEIIADARQAHCNISRA The peptides of the invention could be glycosylated at either or both positions N301 and N332. In some embodiments the glycan is $Man_9GlcNAc_2$.

It is readily understood that peptides which are not biotinylated do not include an N- or C-terminal lysine (or other specific functional groups or residues) for targeting with biotynaltion reagents.

The invention also contemplates peptides which comprise T-cell helper epitope. One non-limiting embodiment includes GTH1 helper epitope. The helper epitope(s) could be at the N- or C-terminus of the peptide.

The peptides of the invention could be multimerized. In some embodiments, the peptides are biotinylated or multimerized. In some embodiments, the multimeric peptides comprise a T-helper epitope, e.g. but not limited to GTH1 epitope. The helper epitope(s) could be at the N- or C-terminus of the peptide. In some embodiments, the peptides are conjugated to a lipid and then multimerized. The lipids could be pegylated. A non-limiting example is V3 (SEQ ID NO: 1) Peg-GTH1-DPPE peptide.

Example 3: Selections of Immunogens to Induce and Boost V3 Antibodies

The following example provides non-limiting embodiments of immunogens and combination of immunogens for use in various immunization schedules.

All selections need a prime which engages the UCA. Non-limiting examples are Some of the general considerations in choosing immunogens for boost in induction of V3 glycan antibodies are as follows: (i)—activate IA4, select for rare mutation; (ii)—select for antibodies that favor the trimer, expand the variation in the autologous signature residue to potentially expand recognition of diversity in the population; (iii)—expose the maturing antibodies to longer loops, even though these viruses are not bound or neutralized as well as viruses with shooter loops, as this is the main constrain on heterologous population breadth and that is what is needed. In some embodiments, immunogens are selected which can do (i) and (iii). In other embodiments, the selection includes immunogens which can do (ii).

Any suitable form of the envelope could be used for prime and/or boost. The envelope used in the compositions and methods of the invention can be a gp160, gp150, gp145, gp140, gp120, gp41, N-terminal deletion variants as described herein, cleavage resistant variants as described herein, or codon optimized sequences thereof. In certain embodiments the composition comprises envelopes as trimers. In certain embodiments, envelope proteins are multimerized, for example trimers are attached to a particle such that multiple copies of the trimer are attached and the multimerized envelope is prepared and formulated for immunization in a human. In certain embodiments, the compositions comprise envelopes, including but not limited to trimers as particulate, high-density array on liposomes or other particles, for example but not limited to nanoparticles. In some embodiments, the trimers are in a well ordered, near native like or closed conformation. In some embodiments the trimer compositions comprise a homogenous mix of native like trimers.

Near-native soluble trimers using the 6R. SOSIP.664 design are capable of generating autologous tier 2 neutralizing plasma antibodies in the plasma (Sanders et al. 2015), which provides a starting point for designing immunogens to elicit broadly neutralizing antibodies. While these trimers are preferentially antigenic for neutralizing antibodies they still possess the ability to expose the V3 loop, which generally results in strain-specific binding and neutralizing antibodies after vaccination. Using the unliganded structure the BG505.6R.SOSIP.664 has been stabilized by adding cysteines at position 201 and 433 to constrain the conformational flexibility such that the V3 loop is maintained unexposed (Kwon et al. 2015).

Stabilized Trimer Immunogen Design. Several SOSIP trimer designs have been generated: 6R.SOSIP.664, disulfide stabilized (DS) 6R.SOSIP.664 (Kwon et al Nature Struc Mol Biol 2015), 6R.SOSIP.664v4.1 (DeTaeye et al. Cell 2016), and 6R.SOSIP.664v4.2 (DeTaeye et al. Cell 2016). The CH848 SOSIP is made as a chimera of C.CH848 and A.BG505. Sequences of various CH848 envelope trimer designs are illustrated in FIGS. 39A-B, 40A-C, and 41A-C. Any one of the CH848 envelope sequences from WO2015/153638 could be designed as SOSIP trimers.

In some embodiments the CHIM.6R.SOSIP.664V4.1 and/or CHIM.6R. SOSIP.664V4.1design is expected to be in closed stabilized conformation. This design is expected to show preferential binding to broad neutralizing antibodies compared to binding to non-neutralizing antibodies. This design is expected to bind to antibodies from the V3 antibodies of Example 1.

The gp120 of C.CH848 envelope was fused with the BG505 inner domain gp120 sequence within the alpha helix 5 (alpha5) to result in a chimeric protein. The chimeric gp120 is disulfide linked to the A.BG505 gp41 as outlined by Sanders et al. (PLOS Path 2013). In some embodiments the immunogens were designed as chimeric proteins that possess the BG505 gp41 connected to the CH848 gp120, since the BG505 strain is particularly adept at forming well-folded, closed state trimers (See FIG. 41C). This envelope design retains the CH848 base of the V3 loop and glycan(s) that are targeted by the DH270 lineage of broadly neutralizing antibody lineages that were isolated from CH848 (Example 1).

Provided are non-limiting examples of selections of envelopes for immunization to induce neutralizing HIV-1 antibodies, including but not limited to broadly neutralizing antibodies with the specificity of antibodies from the DH270 lineage. One non-limiting embodiment of the V3 peptide used as a prime is: EINCTRPNNNTRPGEIIGDIRQAHCNISRA (SEQ ID NO: 1) as aglycone or as Man9GlcNAc2 glycosylated at both N301 and N332.

The envelopes could be administered in any suitable form, as nucleic acids, amino acids and/or combination. a gp160, gp150, gp145, any suitable form of a trimer, for example but not limited to SOSIP trimers, preferably in a closed conformation, gp140 (including but not limited to gp140C, gp140CF, gp140CFI), gp120, gp41, N-terminal deletion variants (e.g. delta 11 deletions) as described herein, cleavage resistant variants, or codon optimized sequences thereof. Non-limiting examples of sequences are provided in FIGS. 39A-B, 40A-C, and 41A-C. The boost could be sequential or additive.

Selection I:

V3 glycopeptide and/or aglycone peptide (SEQ ID NO: 1) as a prime; Boost: CH848.0949.10.17; CH848.0358.80.06; CH848.1432.5.41; CH848.0526.25.02. See FIG. 37A and FIG. 28 in Example 1.

Selection II:

V3 glycopeptide and/or aglycone peptide as a prime; Boost: CH848.0949.10.17; CH848.0836.10.31; CH848.0358.80.06; CH848.1432.5.41; CH848.0526.25.02. See FIG. 37A and FIGS. 27A-B, 18A-B, and 28 in Example 1.

Selection III:

V3 glycopeptide and/or aglycone peptide as a prime; Boost: CH848.0949.10.17; CH848.d1120.10.21; CH848.d1432.05.27. See FIG. 37B.

Selection IV:

V3 glycopeptide and/or aglycone peptide as a prime; Boost: CH848.0949.10.17; CH848.d1120.10.21; CH848d0949.10.18; CH848.d1432.05.27. See FIG. 37C.

Selection V:

V3 glycopeptide and/or aglycone peptide as a prime; Boost: CH848.0949.10.17; CH848.0794.05.14; CH848.0358.80.06; CH848.1432.5.41; CH848.0526.25.09; CH848.0526.25.02.

Selection VI:

CH848.0949.10.17 trimer as a prime, boost: CH848.0949.10.17; optionally CH848.0836.10.31; CH848.0358.80.06; CH848.1432.5.41; CH848.0526.25.02.

Selection VII:

CH848.0949.10.17 trimer as a prime; could be a V1 loop deglycosylated envelope, boost: CH848.0949.10.17; optionally CH848.0836.10.31; CH848.0358.80.06; CH848.1432.5.41; CH848.0526.25.02; CH0848.3.d1651.10.07.

In any of the above selections the prime could be selected from any of the contemplated envelope designs that show binding to the DH270UCA.

In any one of the above selections, the boost could include CH848.d1305.10.13 and CH0848.3.d1651.10.07 envelope designs to increase the breadth of antibodies.

This example describes additional considerations for selecting CH848 envelopes and modifications of such envelopes for use as immunogens.

CRF02_AG.T250 is an envelope which is very sensitive to V2glycan and V3glycan antibodies, and resistant to CD4bs antibodies. Short positively charged V1 V2's are highly associated with sensitivity, and T250 has among the shortest V1 V2 regions—So do CH848.d0949.10.17 envelope. T250's V1 V2 region could be introduced in any of the envelopes describe herein, e.g. in CH0848.d0949.021.10.17.

The best antibody from the DH270 lineage is DH270.6. Like most V3 antibodies, it requires the N332 PNGS. In addition, D325N is highly associated with resistance, and is a common circulating mutation. Other V3glycan bNAbs can tolerate the mutation, and it arose in CH848 after DH270 lineage antibodies were isolated, likely possibly as an escape from our DH270 lineage. An N325 CH848 envelope isolate could be included in the vaccine to potentially extend breadth when DH270-like linages is started. There are several candidates, but only two had any binding or neutralizing activity CH848.d1305.10.13 and CH0848.3.d1651.10.07. FIGS. 42,43, and 35. As CH848.d1305.10.13 has a proline after the N, GDIR->GNPR (SEQ ID NOS 34 and 35, respectively), which is rare, CH0848.3.d1651.10.07 based envelopes are better vaccine option.

FIGS. 44A, 44B, and 44D show additional envelope designs, to introduce changes in the sequence of CH0848.3.D0949.10.17 to increase the sensitivity of these envelopes to antibodies in the DH270 lineage. Some of the changes affect glycans while others do not impact glycosylation positions.

Table 3 provides a listing of reagents for use as prime(s)/DH270 lineage germline binders and/or boosts (Amino acid sequences of these envelopes are provided in FIG. 45). Reference to amino acid positions is with respect to HXB2 envelope sequence.

| | Protein | Explanation |
|---|---|---|
| 1. | AG.T250-4 Delta10 gp120 | Long V1 loops confers resistance to DH270 antibodies. T250-4 was chosen since the V1 length is very short compared to all other Envs in the HIV sequence database. |
| 2. | T250-4chim.6R.SOSIP.664v4.1 | Chimeric SOSIP of the above AG.T250 envelope. Some bnAb precursor antibodies bind stronger to trimer than gp120 monomers |
| 3. | BG505 SOSIP MUT11B | Selected as a potential binder to DH270 UCA or other lineage members. See Steichen JM, et al. HIV Vaccine Design to Target Germline Precursors of Glycan-Dependent Broadly Neutralizing Antibodies. *Immunity*. 2016; 45(3): 483-496. doi: 10.1016/j.immuni.2016.08.016. |
| 4. | CH0848.3.D0949.10.17gp140c | Long V1 loops confers resistance to DH270 antibodies. Autologous Env with a short V1 loop. |
| 5. | CH0848.3.D0836.10.31gp140C | DH270 antibodies recognize the GDIR motif (SEQ ID NO: 34) at the base of the V3 loop. The D325 makes critical contact with R57 in the DH270. The UCA of DH270 is G57 not R57. CH0848.3.D0836.10.31 has a N325 change that may bind better to the R57 of the UCA. |
| 6. | CH848.3.D0949.10.17_GT1_D11gp120 | Mutations that were helpful in getting 11MUTB to bind to PGT121 were analyzed and similar mutations were constructed into CH848 D949.10.17 to create an Env that might bind to the DH270 UCA. See Steichen JM, et al. HIV Vaccine Design to Target Germline Precursors of Glycan-Dependent Broadly Neutralizing Antibodies. *Immunity*. 2016; 45(3): 483-496. doi: 10.1016/j.immuni.2016.08.016. |
| 7. | BG505_MUT11B D11 gp120 | Selected as a potential binder to DH270 UCA or other lineage members. See Steichen JM, et al. HIV Vaccine Design to Target Germline Precursors of Glycan-Dependent Broadly Neutralizing Antibodies. *Immunity*. 2016; 45(3): 483-496. doi: 10.1016/j.immuni.2016.08.016. |
| 8. | B.JRFLgp140CF_V1_3Q | V1 glycans block PGT121 from binding to the V3 glycan site (Garces et al. Cell. 2014 Sep 25; 159(1): 69-79. doi: 10.1016/j.cell.2014.09.009; Garces et al. Immunity. 2015 Dec 15; 43(6): 1053-1063). A virus and an Env were constructed where three potential N-linked sites in V1 are deleted. The N is changed to Q hence 3Q. |
| 9. | CON-Sgp140CFI_V1_4Q | V1 glycans block PGT121 from binding to the V3 glycan site (Garces et alSupra). A virus and an Env were constructed where four potential N-linked sites in are V1 deleted. The N is changed to Q hence 4Q. |
| 10 | CH848.3.D0949.10.17CHIM.6R.SOSIP.664V4.1 | Some bnAb precursor antibodies bind stronger to trimer than gp120 monomers. autologous Env made as a stable trimer. |
| 11 | CH0848.3.D0836.10.31CHIM.6R.SOSIP.664V4.1 | Some bnAb precursor antibodies bind stronger to trimer than gp120 monomers. autologous Env made as a stable trimer. |
| 12 | CH0848.3.D0358.80.06CHIM.6R.SOSIP.664V4.1 | Some bnAb precursor antibodies bind stronger to trimer than gp120 monomers. autologous Env made as a stable trimer. |
| 13 | CH848.3.D1432.5.41CHIM.6R.SOSIP.664V4.1 | Some bnAb precursor antibodies bind stronger to trimer than gp120 monomers. autologous Env made as a stable trimer. |
| 14 | CH848.3.D0526.25.02CHIM.6R.SOSIP.664V4.1 | Some bnAb precursor antibodies bind stronger to trimer than gp120 monomers. autologous Env made as a stable trimer. |
| 15 | CH848.3.D0949.10.17CHIM.6R.SOSIP.664V4.1_GT1 | Mutations that were helpful in getting 11MUTB to bind to PGT121 were analyzed and similar mutations were constructed into CH848 D949.10.17 to create an Env that might bind to the DH270 UCA. Some bnAb precursor antibodies bind stronger to trimer than gp120 monomers thus we made the Env as a stable trimer. Also for immunization the native stable trimer has less exposure of nonneutralizing epitopes. |

-continued

| | Protein | Explanation |
|---|---|---|
| 16 | B.JRFLgp120core_mini-V3_v2 | This construct is already published (Kong et al. (2013) Nat.Struct.Mol.Biol. 20: 796-803), but we have been treating the protein with deglycosylases under denaturing and non-denaturing conditions since the UCA of DH270 does not bind free glycan and may interfere with the UCA being able to bind to the base of the V3 loop. This is gp120 with the variable loops 1 and 2 deleted. A truncated V3 loop remains. |
| 17 | CH848.3.D0949.10.17chim.6R.DS.SOSIP.664 | Some bnAb precursor antibodies bind stronger to trimer than gp120 monomers. autologous Env made as a stable trimer. |
| 18 | CH848.3.D0949.10.17chim.6R.DS.SOSIP.664 | Some bnAb precursor antibodies bind stronger to trimer than gp120 monomers. autologous Env made as a stable trimer. |
| 19 | CH848.3.D0949.10.17chim.6R.DS.SOSIP.664_N301AN332A | Some bnAb precursor antibodies bind stronger to trimer than gp120 monomers. This is an autologous Env made as a stable trimer. We then removed the glycans at the base of the V3 loop since the UCA of DH270 does not bind free glycan and the glycans at N301 and N332 may interfere with the UCA being able to bind to the base of the V3 loop. Glycans were removed by mutation of the indicated amino acid position(s). |
| 20 | CH848.3.D0949.10.17chim.6R.DS.SOSIP.664_N332A | Some bnAb precursor antibodies bind stronger to trimer than gp120 monomers. This is an autologous Env made as a stable trimer. We then removed the N332 glycan at the base of the V3 loop since the UCA of DH270 does not bind free glycan and may interfere with the UCA being able to bind to the base of the V3 loop. Glycans were removed by mutation of the indicated amino acid position(s). |
| 21 | CH848.3.D0949.10.17chim.6R.DS.SOSIP.664_N301A | Some bnAb precursor antibodies bind stronger to trimer than gp120 monomers. This is an autologous Env made as a stable trimer. We then removed the N301 glycan at the base of the V3 loop since the UCA of DH270 does not bind free glycan and may interfere with the UCA being able to bind to the base of the V3 loop. Glycans were removed by mutation of the indicated amino acid position(s). |
| 22 | CH848.3.D0949.10.17chim.6R.DS.SOSIP.664_N301A | Some bnAb precursor antibodies bind stronger to trimer than gp120 monomers. This is an autologous Env made as a stable trimer. We then removed the N301 glycan at the base of the V3 loop since the UCA of DH270 does not bind free glycan and may interfere with the UCA being able to bind to the base of the V3 loop. Glycans were removed by mutation of the indicated amino acid position(s). |
| 23 | CH848.3.D0949.10.17chim.6R.DS.SOSIP.664_V1A | Long V1 loops confers resistance to DH270 antibodies. Autologous Env that started with a short V1 loop and we replaced the loop with a GlySerGly linker. |
| 24 | CH848.3.D0949.10.17chim.6R.DS.SOSIP.664_V1B | Long V1 loops confers resistance to DH270 antibodies. Autologous Env that started with a short V1 loop and we replaced the middle 11 amino acids of the V1 loop with a GlySerGly linker. |
| 25 | CH848.3.D0949.10.17chim.6R.DS.SOSIP.664_V1D | Long V1 loops confers resistance to DH270 antibodies. Autologous Env that started with a short V1 loop and we replaced the middle 7 amino acids of the V1 loop with a GlySerGly linker. |
| 26 | CH848.3.D0949.10.17CHIM.6R.SOSIP.664V4.1degly4 | Some bnAb precursor antibodies bind stronger to trimer than gp120 monomers. Autologous Env made as a stable trimer. We then removed the N301 and N332 glycan at the base of the V3 loop since the UCA of DH270 does not bind free glycan and may interfere with the UCA being able to bind to the base of the V3 loop. V1 glycans block PGT121 from binding to the V3 glycan site (Garces et al. see supra). So we made an Env with N137 and N141 potential glycosylation sites in V1 removed. Glycans were removed by mutation of the indicated amino acid position(s). |
| 27 | CH0848.3.D0949.10.17gp140C_degly4 | Some bnAb precursor antibodies bind stronger to trimer than gp120 monomers. Autologous Env made as a uncleaved trimer. We then removed the N301 and N332 glycan at the base of the V3 loop since the UCA of DH270 does not bind free glycan and may interfere with the UCA being able to bind to the base of the V3 loop. V1 glycans block PGT121 from binding to the V3 glycan site (Garces et al Immunity). So we made an Env with N137 and N141 potential glycosylation sites in V1 removed. Glycans were removed by mutation of the indicated amino acid position(s). |
| 28 | B.JRFLgp140C_3QN301SN332T | V1 glycans block PGT121 from binding to the V3 glycan site (Garces et al Immunity). So we made a virus and an Env with three potential N-linked sites in V1 deleted. The N is changed to Q hence 3Q. We then removed the glycans at the base of the V3 loop since the UCA of DH270 does not bind free glycan and the glycans at N301 and N332 may interfere with the UCA being able to bind to the base of the V3 loop. Glycans were removed by mutation of the indicated amino acid position(s). |
| 29 | B.JRFLgp120core_mini-V3_v2_degly | This is gp120 with the variable loops 1 and 2 deleted. A truncated V3 loop remains. We removed the N295A, N301A, N332A glycans at the base of the V3 loop since the UCA of DH270 does not bind free glycan and the glycans at N295A, N301 and N332 may interfere with the UCA being able to bind to the base of the V3 loop. Glycans were removed by mutation of the indicated amino acid position(s). |

Provided and contemplated are envelopes and modified version thereof for use as DH270 lineage germline binders:

Envelope (HV1301265)_JRFL gp140_3QN301SN332T—

Envelope CH848 703010848.3.d0949.10.17_signature_opt_ filled_rare_holes_a_CD5ss gp140C. Contemplated is also a SOSIP design of the envelope CH848 703010848.3.d0949.10.17_signature_opt_filled_rare_holes_a.

Envelope CH0848.3.d1651.10.07_CD5ss gp140C

Envelope CH848 703010848.3.d0949.10.17_signature_opt_b_T250.4_V1V2_CD5ss gp140C. Envelope CH848 703010848.3.d0949.10.17_signature_opt_b_CD5ss gp140C. Contemplated is also a SOSIP design of this envelope.

Envelope T250-4 gp140C

Envelope T250-4chim. 6R. SOSIP.664v4.1

Envelope CH848 703010848.3.d0949.10.17_signature optbCD5ss gp140C. Contemplated is also a SOSIP design of this envelope.

Envelope CH848 703010848.3.d0949.10.17_signature_opt_filled_rare_holes_a_CD5ss gp140C Envelope CH8448 703010848.3.d0949.10.17_signature_opt_filled_rare_holes_a_CD5ss N133AN138A Envelope T250-4 gp140C_N133AN138A—

Envelope JRFL Core with miniV3 (293F produced/KIF treated/EndoH treated). Signature_opt_filled_rare_holes_a designs are also referred to as SOFA design. Additional designs are also contemplated and covered by the invention. Non-limiting embodiments include chimeric trimer designs, which could comprise portions of BG505 envelope (See FIG. 41C for example). Non-limiting embodiments include non-chimeric trimer designs. See for example FIG. 54, Example 3B.

The example describes CH848 envelopes, trimers and additional envelopes, modifications and designs. This example shows that stabilized HIV-1 Env trimer immunogens show enhanced antigenicity. See FIGS. 48A-48B. In some embodiments and are not recognized by non-neutralizing antibodies. In some embodiments these envelopes, including but not limited to trimers are further multimerized, and/or used as particulate, high-density array in liposomes or other particles, for example but not limited to nanoparticles. Any one of the envelopes of the invention could be designed and expressed as described herein. The envelopes of the invention are engineered and tested for binding to various antibodies from the DH270 lineage.

Elicitation of neutralizing antibodies is one goal for antibody-based vaccines. Neutralizing antibodies target the native trimeric HIV-1 Env on the surface virions. The trimeric HIV-1 envelope protein consists of three protomers each containing a gp120 and gp41 heterodimer. Recent immunogen design efforts have generated soluble near-native mimics of the Env trimer that bind to neutralizing antibodies but not non-neutralizing antibodies. The recapitulation of the native trimer could be a key component of vaccine induction of neutralizing antibodies. Neutralizing Abs target the native trimeric HIV-1 Env on the surface of viruses (Poignard et al. J Virol. 2003 January; 77(1):353-65; Parren et al. J Virol. 1998 December; 72(12): 10270-4; Yang et al. J Virol. 2006 November; 80(22):11404-8.). The HIV-1 Env protein consists of three protomers of gp120 and gp41 heterodimers that are noncovalently linked together (Center et al. J Virol. 2002 August; 76(15):7863-7.). Soluble near-native trimers preferentially bind neutralizing antibodies as opposed to non-neutralizing antibodies (Sanders et al. PLoS Pathog. 2013 September; 9(9): e1003618).

Provided here are non-limiting embodiments of well-folded trimers or other engineered forms of envelopes, which bind to the DH270UCA, and/or other DH270 lineage antibodies and are useful for Env immunizations as prime(s) and/or boosts.

Near-native soluble trimers using the 6R. SOSIP.664 design are capable of generating autologous tier 2 neutralizing plasma antibodies in the plasma (Sanders et al. 2015), which provides a starting point for designing immunogens to elicit broadly neutralizing antibodies. While these trimers are preferentially antigenic for neutralizing antibodies they still possess the ability to expose the V3 loop, which generally results in strain-specific binding and neutralizing antibodies after vaccination. Using the unliganded structure the BG505.6R.SOSIP.664 has been stabilized by adding cysteines at position 201 and 433 to constrain the conformational flexibility such that the V3 loop is maintained unexposed (Kwon et al. Nat Struct Mol Biol. 2015 July; 22(7): 522-531.).

Immunogen Design.

Provided are engineered trimeric envelopes, for use as immunogens, wherein the envelopes are based on multiple viruses from CH848, and other viruses with suitable characteristics, e.g. V1 loop length, as described.

We generated chimeric 6R.SOSIP.664, chimeric disulfide stabilized (DS) 6R.SOSIP.664 (Kwon et al Nat Struct Mol Biol. 2015 July; 22(7): 522-531.), chimeric 6R.SOSIP.664v4.1 (DeTaeye et al. Cell. 2015 Dec. 17; 163(7):1702-15. doi: 10.1016/j.cell.2015.11.056), and chimeric 6R.SOSIP.664v4.2 (DeTaeye et al. Cell. 2015 Dec. 17; 163(7):1702-15. doi: 10.1016/j.cell.2015.11.056). The 6R.SOSIP.664 is the basis for all of these designs and is made as a chimera of C.CH0505 and A.BG505. The gp120 of C.CH848 was fused with the BG505 inner domain gp120 sequence within the alpha helix 5 ($\alpha5$) to result in the chimeric protein. The chimeric gp120 is disulfide linked to the A.BG505 gp41 as outlined by Sanders et al. (PLoS Pathog. 2013 September; 9(9): e1003618). These immunogens were designed as chimeric proteins that possess the BG505 gp41 connected to the CH848 gp120, since the BG505 strain is particularly adept at forming well-folded, closed trimers. This envelope design are expected to retain and expose features of the envelopes recognized by DH270 by broadly neutralizing antibody lineages that were isolated from CH848.

FIGS. 39A-B, 40A-C, and 41A-C show nucleic acid and amino acid and sequences of various CH848 and other envelope trimer designs. FIG. 41C shows an annotated sequence of the SOSIP.III design. Based on the various SOSIP designs, any other suitable envelope, for example but not limited to CH848 envelopes as described in WO2015/153638 can be designed.

Recombinant envelopes as trimers could be produced and purified by any suitable method. For a non-limiting example of purification methods see Ringe R P, Yasmeen A, Ozorowski G, Go E P, Pritchard L K, Guttman M, Ketas T A, Cottrell C A, Wilson I A, Sanders R W, Cupo A, Crispin M, Lee K K, Desaire H, Ward A B, Klasse P J, Moore J P. 2015. Influences on the design and purification of soluble, recombinant native-like HIV-1 envelope glycoprotein trimers. J Virol 89:12189-12210. doi: 10.1128/JVI.01768-15.

Multimeric Envelopes

Presentation of antigens as particulates reduces the B cell receptor affinity necessary for signal transduction and expansion (See Baptista et al. EMBO J. 2000 Feb. 15; 19(4): 513-520). Displaying multiple copies of the antigen on a particle provides an avidity effect that can overcome the low affinity between the antigen and B cell receptor. The initial B cell receptor specific for pathogens can be low affinity, which precludes vaccines from being able to stimulate and expand B cells of interest. In particular, very few naïve B cells from which HIV-1 broadly neutralizing antibodies arise can bind to soluble HIV-1 Envelope. Provided are envelopes, including but not limited to trimers as particulate, high-density array on liposomes or other particles, for example but not limited to nanoparticles. See e.g. He et al. Nature Communications 7, Article number: 12041 (2016), doi:10.1038/ncomms12041; Bamrungsap et al. Nanomedicine, 2012, 7 (8), 1253-1271.

To improve the interaction between the naïve B cell receptor and CH848 SOSIP trimer protein we created to two constructs that can be presented on particles. The first construct was made by fusing HIV-1 Envelope trimer CH848 to ferritin. Ferritin protein self assembles into a small nanoparticle with three fold axis of symmetry. At these axis CH848 envelope protein was fused. Therefore the assembly of the three-fold axis also clusters three HIV-1 envelope protomers together to form an envelope trimer. Each ferritin particle has 6 axis which equates to 6 CH848 trimers being displayed per particle. See e.g. Sliepen et al. Retrovirology 201512:82, DOI: 10.1186/s12977-015-0210-4.

Another approach to multimerize expression constructs uses *staphylococcus* Sortase A transpeptidase ligation to conjugate CH848 envelope trimers to cholesterol. The CH848 trimers can then be embedded into liposomes via the conjugated cholesterol. To conjugate the CH848 trimer to cholesterol either a C-teminal LPXTG tag (SEQ ID NO: 60) or a N-terminal pentaglycine repeat tag (SEQ ID NO: 61) was added to the CH505 envelope trimer gene. Cholesterol was also synthesized with these two tags. Sortase A was then used to covalently bond the tagged CH505 envelope to the cholesterol. The sortase A-tagged trimer protein can also be used to conjugate the trimer to other peptides, proteins, or fluorescent labels.

The invention provides design of envelopes and trimer designs wherein the envelope comprises a linker which permits addition of a lipid, such as but not limited to cholesterol, via a Sortase A reaction. See e.g. Tsukiji, S. and Nagamune, T. (2009), Sortase-Mediated Ligation: A Gift from Gram-Positive Bacteria to Protein Engineering. ChemBioChem, 10: 787-798. doi:10.1002/cbic.200800724; Proft, T. Sortase-mediated protein ligation: an emerging biotechnology tool for protein modification and immobilisation. Biotechnol Lett (2010) 32: 1. doi:10.1007/s10529-009-0116-0; Lena Schmohl, Dirk Schwarzer, Sortase-mediated ligations for the site-specific modification of proteins, Current Opinion in Chemical Biology, Volume 22, October 2014, Pages 122-128, ISSN 1367-5931, dx.doi.org/10.1016/j.cbpa.2014.09.020; Tabata et al. Anticancer Res. 2015 August; 35(8):4411-7.

The lipid modified envelopes and trimers could be formulated as liposomes. Any suitable liposome composition is contemplated.

Non-limiting embodiments of envelope designs for use in Sortase A reaction are shown in FIG. 47B-C.

Design of Trimers with Readthrough Codons

The development of clonal cell lines that highly express trimeric HIV-1 Envelope will facilitate manufacturing of high quality proteins for clinical and research purposes. However, it is challenging to identify the cells that express trimeric protein among the many cells making various forms of HIV-1 Envelope with in the cell population. To identify cells expressing trimeric HIV-1 Envelope protein, we designed an expression construct that simultaneously produces both secreted Envelope protein as well as membrane anchored Envelope protein. The secreted Envelope protein can be purified using standard methods and results in unaltered soluble envelope. The membrane-anchored Envelope protein serves to mark the cells within a population of cells that expresses trimeric Envelope. More specifically, the trimeric Envelope expressing cells are sorted by fluorescence-activated cell sorting using a HIV-1 trimer specific antibody. The sorted cells can then be used to initiate clonal populations of cells that have been phenotypically shown to express the protein of interest.

The expression construct is designed by taking advantage of the amber stop codon UAG in messenger RNA. The codon UAG usually signifies the end of the polypeptide sequence, but at a low rate the ribosome can readthrough this stop codon and continue to elongate the polypeptide chain. We incorporated this stop codon into our protein construct followed by the natural BG505 gp41 transmembrane and cytoplasmic tail sequence ended with two stop codons. Therefore, when the stop codon is readthrough a membrane-anchored gp120/gp41 heterodimer is formed. Loughran et al. (Nucleic Acids Res. 2014 August; 42(14): 8928-38. doi:10.1093/nar/gku608) identified that the efficiency of readthrough could be increased by flanking the amber stop codon with the nucleotides CTA. Readthrough could be even further augmented with the addition of CTAG nucleotides after the amber stop codon. We engineered expression constructs with both modifications to ensure an optimal ratio of membrane-anchored and secreted trimeric Envelope protein. Since the CTAG creates a shift in reading frame we added GC nucleotides after the CTAG motif to preserve the original reading frame. The addition of CTAGGC results in the membrane anchored protein having a leucine and glycine residue expressed before the transmembrane domain. Any one of the envelopes of the invention could be designed and expressed as readthrough envelopes.

Example 4: Animal Studies

Various selections of immunogens will be tested in animal models. Any suitable animal model will be used. Such animal models include mouse models, including humanized mice carrying human immunoglobulin locus, guinea pigs, rabbits, non-human primates, or any other model. Adults and neonates could be used in the studies.

Mouse study: prime with Man9 V3 (SEQ ID NO: 1) glycan monomer with adjuvant LASTS. Boost at least twice with CH848 d0949.10.17Δ11 gp120 with adjuvant, e.g. LASTS.

Mouse study: prime with V3 (SEQ ID NO: 1) aglycan monomer with adjuvant LASTS. Boost at least twice with CH848 d0949.10.17Δ11 gp120 with adjuvant LASTS.

In the immunogenic methods of the invention, the first boost after the prime comprises CH848 d0949.10.17 envelope either as a protein or nucleic acid in any suitable form.

The adjuvant in the above studies could be any suitable adjuvant, for example but no limited to polyIC or polyIC/LC.

Example 5

Modification of HIV Env glycosylation augments binding to unmutated common ancestor and intermediate antibodies of V3-glycan broadly neutralizing antibody lineages. This example investigates whether envelope designs with a short V1 loop and no glycans near N137 engage the DH270 UCA.

Example 5 shows data for one non-limited embodiment of a deglycosylated envelope. These data include antigenic and immunogenic characterization of the envelope, and characterization of immunogenic responses in animals immunized with the deglycosylated envelope CH848.3.D0949.10.17CHIM.6R.SOSIP.664V4.1_N133DN138T.

Additional trimer designs based on CH848.3.D0949.10.17 envelope are also contemplated as deglycosylated immunogens.

The recombinant envelopes in this example are expressed in mammalian cells and purified by methods known in the art.

In a study described in Example 1 (Bonsignori et al. *Sci. Transl. Med.* 9, eaai7514 (2017)), we described the antibody lineage called DH270 that was isolated from an HIV-infected individual called CH0848. We isolated this lineage using memory B cell cultures and single B cell sorting followed by RT-PCR. In total we isolated 6 natural antibody heavy chain and light chain pairs. The most potent and broad neutralizing antibody of the lineage neutralized 71% of viruses tested. Using these antibodies, we inferred a unmutated common ancestor or UCA antibody using the Cloanalyst program. The UCA lacks any somatic mutation and is our best approximation of the germline starting point for the DH270 lineage. In this study, autologous Envs were isolated from CH0848 covering 4.5 years of infection. A subset of these Envs were used to identify Envs that were engaged by various members of the DH270 lineage throughout its developmental pathway. The identified Envs are being used to design B cell lineage sequential vaccines. However, no Env was identified that bound the DH270 UCA antibody. Antibody DH270 binding and neutralization inversely correlates with HIV-1 Env V1 loop length. V1 glycans inhibit V3-glycan bnAb inter-PGT122 lineages and the N137 glycan in the V1 loop needs to be accommodated for early lineage member binding to BG505 SOSIP. Garces F. et al. Immunity 43, 1053-1063 (2015); Garces et al. Cell 159, 69-78 (2014); Steichen et al. Immunity 45, 483-496 (2016).

An autologous Env from the CH0848 individual was identified—this envelope called CH0848.D0949.10.17, which possessed a 17 amino acid V1 loop. It had glycosylation sites within the V1 loop at positions 133, 138 and N156. We removed the N133 and N138 glycans by substituting in amino acids that naturally occur at those sites. We made a SOSIP trimer derived from the CH0848.10.17 sequence (see for example FIG. 49A as a non-limiting embodiment). We also made a CH0848 10.17 SOSIP trimer lacking the N-linked glycosylation sites at positions 133 and 138 (see for example FIG. 49A as a non-limiting embodiment). FIG. 58 shows analysis of trimer formation by negative stain electron microscopy. Shown here are the 2D class averages of each of the soluble trimers—for the 32 classes, both Envs were trimeric.

FIG. 59 shows analysis of the antigenicity of the trimers. As part of our initial characterization of the trimers we analyze binding of 19 different antibodies targeting diverse epitopes on Env in biolayer interferometry assays. Shown here are four of the 19 antibodies, including trimer-specific broadly neutralizing antibody PGT151, and non-neutralizing antibodies A32, CH58, and 17B, which target the C1, linear V2 peptide, and coreceptor binding site on Env. Both of the trimers bound strongly to PGT151 as indicated by the red curves. The nonneutralizing antibodies against the various epitopes showed no binding, which suggested these Envs were not in the CD4 induced conformation.

This example investigated whether soluble, recombinant Env proteins derived from CH0848.D0949.10.17 engage the DH270 UCA. FIG. 60 shows that DH270 UCA binds SOSIP trimers, but not uncleaved gp140 oligomers or monomeric gp120. We performed SPR assays where the DH270 UCA Fab captured on BiaCore sensor chips and serial dilutions of the different forms of WT CH0848.D0949.10.17 Envs were flowed over the antibody. Interestingly we observed that only the SOSIP trimer bound to the UCA. The binding was weak but was calculated to be 2600 nM affinity. Our earlier binding screens were performed with monomeric gp120s, with which we would have missed this interaction.

We also investigated whether DH270 UCA binding to CH0848.D0949.10.17 SOSIP could be limited by the V1 glycans at N133 and N138. FIG. 61 shows that CH0848 10.17 N133D N138T SOSIP engages the DH270 UCA Fab with 29 nM affinity. We tested the binding of the DH270 UCA Fab using BIACore as I previously described. The binding results are summarized in the table on the left and the data for the N133D N138T mutant Env is shown on the left where each curve represents a different concentration of CH0848.10.17 N133D N138T SOSIP. Removal of the glycosylation sites at position 133 and 138 resulted in a 100-fold improvement in DH270 UCA affinity as highlighted in blue. The SOSIP trimers are mimics of the native, thus we wondered whether the V1 glycans inhibited DH270 UCA binding to CH0848.D949.10.17 native trimers on virions.

FIG. 62A shows that V1 glycans inhibit DH270 UCA recognition of native Env trimers. We made a pseudovirus expressing the wildtype 10.17 Env with the glycans or expressing the N133D N138T mutant version of 10.17. The DH270 UCA did not neutralize the wildtype 10.17 virus, however, the broadly neutralizing antibody DH270.7 potently neutralized the virus. When removed the two glycans at position N133 and N138 the DH270 UCA was now able to neutralize at a IC50 titer of 1.7 ug/mL. Also, the bnAb DH270.6 more potently neutralized the V1 glycan modified virus. FIG. 62B shows that V1 glycan deletion was not solely sufficient for neutralization sensitivity since we performed the same experiment with JR-FL pseudoviruses and despite removing the V1 glycans at three positions the DH270 UCA still could not neutralize the virus. We also did not detect any binding to JR-FL N135Q N137Q N141Q SOSIPs. Therefore, the DH270 UCA binding and neutralization of the autologous virus likely requires specific amino acids in addition to the removal of glycans.

We investigated the structural basis for N133 and N138 glycan inhibition of DH270 UCA binding to trimer. FIG. 63 shows a model of DH270.6 binding to SOSIP trimer and potential N137 glycan interference. The crystal structure of the most broad and potent DH270 antibody called DH270.6 in complex with a glycosylated peptide antigen bearing the N332 and N301 glycans solved. We used that structure to model the DH270.6 interaction with the glycosylated BG505 SOSIP. In this model the N137 glycan shown in orange clashed with the heavy chain. Thus elimination of this glycan would be predicted to improve antibody: Env interaction. We saw that the N133 glycan was not directly clashing with the antibody. However, we found that the N133 glycan interacts with the V1 loop. We hypothesize that the N133 glycan would buttress the V1 loop and limit its flexibility.

We investigated whether CH0848 N133D N138T trimer stimulate B cells encoding the DH270 UCA. FIG. 64 shows that CH0848 N133D N138T SOSIP induces Ca2+ flux in DH270 UCA and DH270 Ramos cell lines. We first performed calcium flux assays where the DH270 UCA, DH270.1, or a negative control Flu antibody was expressed on Ramos B cells. We added the trimer and measured calcium flux using FuraRed. The cells expressing the flu antibody showed no Calcium flux where the cells expressing either the DH270 UCA or DH270.1 neutralizing antibody fluxed calcium.

FIG. 65 shows DH270 UCA knock-in (DH270 UCA $VH^{+/-}$, DH270 UCA $VL^{+/-}$) mice SOSIP immunization regimen. We next examined whether the soluble trimer could activate the DH270 UCA in vivo. DH270 UCA knock-in mouse model was created for these immunization studies. In this mouse the rearranged DH270 UCA variable region is knocked in for both the heavy chain and the light chain and the mouse is heterozygous for the knock-in genes. We immunized this mouse every two weeks six times with 25 micrograms of the CH848.D0949.10.17 N133D/N138T SOSIP. The immunized group was compared to control animals that received the GLA-SE adjuvant only.

FIG. 66 shows that immunization with N133D/N138T SOSIP induced SOSIP-binding antibodies in DH270 UCA knock in mice. We first looked at the binding antibodies elicited against the CH848 10.17 N133D N138T by the vaccination. Using ELISA we measured binding titers represented as log area under the curve and observed that autologous binding antibodies were elicited in all five mice by the third immunization. The binding titers continued to be boosted with subsequent immunizations. This response was specific to the Env immunogen since the adjuvant only mice did not mount any binding responses. We wondered whether the glycans have to be removed in order for the antibodies to bind.

FIG. 67 shows that DH270 UCA knock-in mouse serum antibodies can bind to CH0848.D949.10.17 in the presence of N133 and N138 glycans. We added the V1 glycans back to the Env, and while titers decreased they were still detectable in all of the mice.

We investigated whether vaccine-induced antibodies possess autologous neutralizing activity. FIG. 68 shows that DH270 UCA knock-in mouse sera neutralize CH0848.D0949.10.17 lacking the N133/N138 glycans. The pre-immune sera and the sera one week after the sixth and final boost were tested for neutralization of the 10.17DT virus. Neutralization titers are shown here as serum reciprocal dilution that neutralized 50% of viral replication. The trimer immunized animals are shown on top and the adjuvant only group is shown on the bottom. None of the serum samples neutralized the negative control virus, Murine leukemia virus. All 5 mice potently neutralized the CH0848DT (CH0848.3.D949.10.17 N133D/N138T) virus that matched the immunogen with titers ranging from 7,500 to 126,000.

FIG. 69 shows that DH270 UCA knock-in mouse sera neutralize tier 2 virus CH0848.D0949.10.17 with N133/N138 glycan. We next tested the neutralization activity against the tier 2 virus CH0848 10.17 virus that has the V1 glycosylation site present. The presence of the glycans reduced neutralization of the 10.17 virus, but titers still ranged from 141 to 1118. Thus, neutralizing antibodies elicited after six vaccinations of DH270 UCA mice with a glycan modified immunogen were able to neutralize the wildtype virus with the natural glycan shield.

Experiments in this example show that DH270 UCA preferentially bound autologous SOSIP trimers, but not gp120 or uncleaved gp140 versions of the same Env; that the glycans in the V1 loop are not only inhibitory for PGT121, but also are inhibitory for other V3 glycan antibodies such as DH270; that the CH0848 10.17N133DN138T SOSIP elicited binding and neutralizing antibodies against the unmodified, WT CH0848 10.17 virus in rearranged DH270 UCA knock in mice.

We investigated whether N133/N138 lacking viruses are found in circulation in CH0848 individual envelope sampling. Natural Envs with 17 aa V1 loops lacking N133/N138 glycans are present during in CH0848 infection. FIG. 70 shows that a CH0848 natural Env with a 17 aa V1 loop and naturally lacking N133 and N138 glycan has eliminated the N295, N301, and N332 glycans. FIG. 70 shows JRFL, CH0848.D1305.10.19, and CH0848.D949.10.17 V3 loop alignment. See FIG. 49B for sequence of CH0848.D1305.10.19. FIG. 71 shows that DH270 UCA does not bind CH0848 natural Env that has a 17 aa V1 loop and lacks N133 and N138 glycans. FIG. 72 shows that DH270-resistant CH0848 natural Env with a 17 aa V1 loop and no N133 and N138 glycan acquire V2 apex bnAb binding (PGT145). FIG. 73 shows that DH270 UCA knock-in sera block V3-glycan bnAb binding to gp120.

NHP 144: CH0848 10.17N133DN138T SOSIP was used as an immunogen in a non-human primate study. Regimen was as follows: week 0-all groups CH848.d949.10.17_N301A_SOSIP (100 ug), IM injection in GLA-LSQ; week 4—Group 1: CH65 IgG (α-HA) 10 mg/kg IV infusion, Group 2: Ipilimumab (α-CTLA-4) 10 mg/kg IV infusion, Group 3: RH anti-tac 1 mg IV infusion, Group 4: Ipilimumab (α-CTLA-4) 10 mg/kg IV infusion+RH anti-tac 1 mg IV infusion)+CH848.d949.10.17_N301A_SOSIP (100 ug), IM injection in GLA-LSQ; week 10—Group 1: CH65 IgG (α-HA) 10 mg/kg IV infusion, Group 2:Ipilimumab (α-CTLA-4) 10 mg/kg IV infusion, Group 3: RH anti-tac 1 mg IV infusion, Group 4: Ipilimumab (α-CTLA-4) 10 mg/kg IV infusion+RH anti-tac 1 mg IV infusion)+CH848.3.D0949.10.17CHIM.6R.SOSIP.664V4.1_N133DN138T (100 ug) IM injection in GLA-LSQ; week 16—Group 1: CH65 IgG (α-HA) 10 mg/kg IV infusion+CH848.d949.10.17 SOSIP (100 ug) IM injection in GLA-LSQ, Group 2: Ipilimumab (α-CTLA-4) 10 mg/kg IV infusion+CH848.d949.10.17 SOSIP (100 ug) IM injection in GLA-LSQ, Group 3-4: CH848.d949.10.17 SOSIP (100 ug) IM injection in GLA-LSQ; week 22-all groups CH848.d8369.10.31 SOSIP (100 ug) IM injection in GLA-LSQ.

Following two immunizations with CH848.d949.10.17_N301A_SOSIP and a third immunization with CH848.d949.10.17 N133DN138T SOSIP that have been demonstrated to bind to the germline precursor of the V3-glycan bnAb DH270 lineage as a priming immunization regimen, then boosting with the CH848.d949.10.17 with all glycan sites intact we can detect serum antibody neutralization (FIG. 74D) of the CH848.d949.10.17_N133DN138T pseudovirus in the TZM-bl neutralization assay at weeks 18 and/or 24 for 3 of the 4 animals in the anti-CTLA-4 blocking antibody group, 2 of the 4 animals in the rhesus anti-CD25 (RH anti-tac) antibody groups and 1 of 4 animals in the combination antibody treated group. None of the control antibody treated animals (CH65) developed neutralization of this double glycan deleted virus. Additionally, none of the antibody treated animals that could neutralize the CH848.d949.10.17_N133DN138T virus could neutralize the CH848.d949.10.17 virus with both glycan sites added back. This indicates targeting of the neutralizing antibody response to a similar V3-glycan site as the DH270 bnAb, but antibody maturation has not occurred that allows accommodation of the N133 and N138 glycan sites. No neutralization was detected against control SVA-MLV virus. Samples from additional weeks, e.g. Weeks 6 and 12, are tested for neutralization to determine if neutralization was induced after the N301A prime.

SOFA deglycosylated envelopes (See Example 3 and FIG. 50) will be analyzed in mouse and non-human primate immunization studies.

Table 4 is summary of various designs of V1 deglycosylated envelopes

| | Envelope | Figure |
|---|---|---|
| 1. | CH848.3.D0949.10.17CHIM.6R.SOSIP.664V4.1_N133DN138T (amino acid) | FIG. 49A |
| 2. | Alignment of CH848.3.D0949.10.17CHIM.6R.SOSIP.664V4.1_N133DN138T And CH848.3.D0949.10.17CHIM.6R.SOSIP.664V4.1 | |
| 3. | >CH0848.3.d1305.10.19gp160 (Amino acid and nucleic acid) | 49B |
| 4. | >CH848.3.D1305.10.19ch.DS.SOSIP.664 (Amino acid) | 50A |
| 5. | >CH848.3.D0949.10.17CHIM.SOSIPV5.2.8_N133DN138T (amino acid) | 50B |
| 6. | >CH848.3.D0949.10.17SOFA.DS.chSOSIP (amino acid) | 50B |
| 7. | >CH848.3.D0949.10.17SOFA.DS.chSOSIP_N133N138A (amino acid) | 50B |
| 8. | >JRFL_SOSIPv6_V1_PNGS (removed V1 glycosylation sites except N156) (Amino acid) | 50C |
| 9. | >CON-Schim.6R.DS.SOSIP.664_OPT_N130D_N135K_N138S_N141S (amino acid) | 50D |
| 10. | >CON-Schim.6R.DS.SOSIP.664_OPT_N138S_N141S (amino acid) | 50D |
| 11. | T250-4CHIMSOSIPV5.2.8 | 51 |
| 12. | T250-4CHIMSOSIPV5.2.8_N160K | 51 |
| 13. | CH848.3.D0949.10.17CHIM.SOSIPV5.2.8 | 51 |
| 14. | WITOCHIM.SOSIPV5.2.8 | 51 |
| 15. | ZM233CHIM.SOSIPV5.2.8 | 51 |
| 16. | A.Q23_17CHIM.SOSIPV5.2.8 | 51 |
| 17. | CM244CHIM.SOSIPV5.2.8 | 51 |
| 18. | CH848.3.D0949.10.17CHIM.SOSIPV5.2.8_N133DN138T | 51 |
| 19. | CH848.3.D0949.10.17CHIM.SOSIPV5.2.8_N301A | 51 |
| 20. | >CH848d949.10.17_N133DN138T_SOSIPv5.2.8gp160 (Amino acid) | 52 |
| 21. | Alignment of amino acids of: >CH848d949.10.17_N133DN138T_SOSIPv5.2.8gp160 And >CH848d949.10.17_N133DN138T_SOSIPv5.2.8 | 52 |
| 22. | >CH848.3.D0949.10.17CHIM.SOSIPV5.2.8_N133DN138T | 53A |
| 23. | >CH848.3.D949.10.17_N133DN138TchimericSOSIP CH848.3.D949.10.17_N133DN138T as a first generation .664 SOSIP Amino acid | 54A |
| 24. | >CH848.3.D949.10.17_N133DN138TSOSIP.664 CH848.3.D949.10.17_N133DN138T as a first generation .664 SOSIP Amino acid | 54A |
| 25. | >CH848.3.D949.10.17_N133DN138TchimericDS.SOSIP CH848.3.D949.10.17_N133DN138T plus the disulfide that blocks CD4 induced conformational changes Amino acid | 54B |
| 26. | >CH848.3.D949.10.17_N133DN138TDS.SOSIP CH848.3.D949.10.17_N133DN138T plus the disulfide that blocks CD4 induced conformational changes Amino acid | 54B |
| 27. | >CH848.3.D949.10.17_N133DN138TchimericTD8.DS.SOSIP CH848.3.D949.10.17_N133DN138T plus the disulfide that blocks CD4 induced conformational changes and Rich Wyatt's .8 mutations: D47, E49, K65, T106, L165, R429, Q432, R500 Amino acid | 54C |
| 28. | >CH848.3.D949.10.17_N133DN138TTD8.DS.SOSIP.664 CH848.3.D949.10.17_N133DN138T plus the disulfide that blocks CD4 induced conformational changes and Rich Wyatt's .8 mutations: D47, E49, K65, T106, L165, R429, Q432, R500 Amino acid | 54C |
| 29. | Schematic diagram of CH848.3.D949.10.17_N133DN138TchimericTD8.DS.SOSIP | 54D |
| 30. | Annotates amino acid sequence of CH848.3.D949.10.17_N133DN138TchimericTD8.DS.SOSIP | 54E |

-continued

| Envelope | Figure |
|---|---|
| 31. Alignment of amino acid sequences in FIGS. 54A, B and C | 54F |
| 32. >CH848.3.D0949.10.17CHIM.6R.SOSIP.664V4.1degly3 HV1301331_degly3: This Env has N138, N133, and N301 glycans removed. These glycans were believed to prevent DH270 mAb binding by blocking access to HIV peptide binding | 77A |
| 33. >CH848.3.D0949.10.17CHIM.6R.SOSIP.664V4.1_N138T HV1301331_N138T: this Env has a single V1 glycan removed. This Env would be used to sequentially add back glycans in the V1 loop to select antibodies capable of tolerating N301 and N133 glycans but not N138T. This Env could be used in a sequential Env vaccine where glycans are removed and added back sequentially | 77B |
| 34. >CH848.3.D0949.10.17chim.6R.DS.SOSIP.664_D368R HV1301345_D368R: Env has D368R mutation to reduce CD4 binding. CD4 binding could disrupt Env conformation in vivo | 77C |
| 35. >CH848.3.D0949.10.17CHIM.6R.SOSIP.664V4.1N133DN138T_c-SORTA HV1301331_N133DN138T_c-SORTA: Tagged Env that can be ligated to particles by sortase A enzyme | 77D |
| 36. >CH848.3.D0949.10.17chDS.SOSIP_N133DN138T-ferritin HV1301522: Ferritin particle with V1 glycan mutant Env attached as a fusion protein | 77E |
| 37. >CH848.3.D0949.10.17chim.6R.DS.SOSIP.664_N133D_N138T_cSORTA HV1301345_N133D_N138T_cSORTA: Tagged Env that can be ligated to particles by sortase A enzyme reactions in vitro. | 77F |
| 38. >CH848.3.D0949.10.17N133D138T_CD5ss gp160 opt HV1301581: Full length gp160 HIV Env with V1 glycans removed to engender DH270 UCA binding. | 77G |
| 39. >CH848.3.D0949.10.17chim.6R.DS.SOSIP.664_TFV1loop HV1301345_TFV1loop: The 10.17 Env with a long V1 loop that was transplanted from the TF virus sequence. This can be used to select for antibodies capable of accommodating a long V1 loop | 77H |
| 40. >CH848.3.D0949.10.17chim.6R.DS.SOSIP.664_N133DN138T HV1301345_N133D_N138T: Stabilized trimer with V1 glycans removed to facilitate DH270 UCA binding | 77I |
| 41. > CH848.3.D0949.10.17.6R.SOSIP.664 (no avi tag) HV1301262(has avi tag): Non-chimeric Env | 77J |
| 42. > CH848.3.D0949.10.17chim.6R.DS.SOSIP.664 (no avi tag) HV1301263(has avi tag): Chimeric DS Env without V1 glycan mutated | 77K |
| 43. > CH848.3.D0949.10.17.6R.DS.SOSIP.664 (no avi tag) HV1301264 (has avi tag): Non-chimeric DS stabilized CH0848 trimer | 77L |
| 44. Annotated sequence of CH848.3.D0949.10.17.6R.SOSIP.664 | 78A |
| 45. Annotated sequence of CH848.3.D0949.10.17 SOSIPv5.2.8 | 78B |

CH848.3.D0949.10.17 SOSIP trimers were also analyzed for their antigenicity in the presence of BMS compound(s) which inhibit binding of CD4 to the envelope. See e.g. Langley et al. Proteins 2015; 83:331-350. Trimer antigenicity in the presence of the inhibitor was not affected—see FIGS. 79 and 80.

Animal studies comparing immunogenicity of envelopes in the presence and absence of BMS-626529 CD4 binding inhibitors will be conducted.

SEQUENCE LISTING (583 sequences)

SEQ ID NO: 1 - protein, 30 aa, Artificial Sequence
  Description of Artificial Sequence: Synthetic polypeptide
EINCTRPNNNTRPGEIIGDIRQAHCNISRA

SEQ ID NO: 2 - protein, 28 aa, Artificial Sequence
  Description of Artificial Sequence: Synthetic peptide
EIVCTRPGNNTRKSVRIGPGQTFYATGK

SEQ ID NO: 3 - protein, 28 aa, Artificial Sequence
  Description of Artificial Sequence: Synthetic peptide
TRPGNNTRKSVRIGPGQTFYATGDIIGK

SEQ ID NO: 4 - protein, 28 aa, Artificial Sequence
  Description of Artificial Sequence: Synthetic peptide
TRKSVRIGPGQTFYATGDIIGDIRQAHK

SEQ ID NO: 5 - protein, 28 aa, Artificial Sequence
  Description of Artificial Sequence: Synthetic peptide
VRIGPGQTFYATGDIIGDIRQAHCNISK

SEQ ID NO: 6 - protein, 28 aa, Artificial Sequence
  Description of Artificial Sequence: Synthetic peptide
QTFYATGDIIGDIRQAHCNISERQWNKK

SEQ ID NO: 7 - protein, 28 aa, Artificial Sequence
  Description of Artificial Sequence: Synthetic peptide
KQTFYATGDIIGDIRQAHCNISERQWNK

SEQ ID NO: 8 - protein, 28 aa, Artificial Sequence
  Description of Artificial Sequence: Synthetic peptide
EIVCTRPNNNTRKSVRIGPGQTFYATGK

SEQ ID NO: 9 - protein, 28 aa, Artificial Sequence
  Description of Artificial Sequence: Synthetic peptide
TRPNNNTRKSVRIGPGQTFYATGDIIGK

SEQ ID NO: 10 - protein, 28 aa, Artificial Sequence
  Description of Artificial Sequence: Synthetic peptide
TRKSVRIGPGQTFYATGDIIGDIKQAHK

SEQ ID NO: 11 - protein, 28 aa, Artificial Sequence
  Description of Artificial Sequence: Synthetic peptide
VRIGPGQTFYATGDIIGDIKQAHCNISK

SEQ ID NO: 12 - protein, 28 aa, Artificial Sequence
  Description of Artificial Sequence: Synthetic peptide
QTFYATGDIIGDIKQAHCNISEEKWNDK

SEQ ID NO: 13 - protein, 28 aa, Artificial Sequence
  Description of Artificial Sequence: Synthetic peptide
KQTFYATGDIIGDIKQAHCNISEEKWND

SEQ ID NO: 14 - protein, 27 aa, Artificial Sequence
  Description of Artificial Sequence: Synthetic peptide
EIVCTRPGNNTRKSVRIGPGQTFYATG

SEQ ID NO: 15 - protein, 27 aa, Artificial Sequence
  Description of Artificial Sequence: Synthetic peptide
TRPGNNTRKSVRIGPGQTFYATGDIIG

SEQ ID NO: 16 - protein, 27 aa, Artificial Sequence
  Description of Artificial Sequence: Synthetic peptide
TRKSVRIGPGQTFYATGDIIGDIRQAH

SEQ ID NO: 17 - protein, 27 aa, Artificial Sequence
  Description of Artificial Sequence: Synthetic peptide
VRIGPGQTFYATGDIIGDIRQAHCNIS

SEQ ID NO: 18 - protein, 27 aa, Artificial Sequence
  Description of Artificial Sequence: Synthetic peptide
QTFYATGDIIGDIRQAHCNISERQWNK

SEQ ID NO: 19 - protein, 27 aa, Artificial Sequence
  Description of Artificial Sequence: Synthetic peptide
QTFYATGDIIGDIRQAHCNISERQWNK

SEQ ID NO: 20 - protein, 27 aa, Artificial Sequence
  Description of Artificial Sequence: Synthetic peptide
EIVCTRPNNNTRKSVRIGPGQTFYATG

SEQ ID NO: 21 - protein, 27 aa, Artificial Sequence
  Description of Artificial Sequence: Synthetic peptide
TRPNNNTRKSVRIGPGQTFYATGDIIG

SEQ ID NO: 22 - protein, 27 aa, Artificial Sequence
  Description of Artificial Sequence: Synthetic peptide
TRKSVRIGPGQTFYATGDIIGDIKQAH

SEQ ID NO: 23 - protein, 27 aa, Artificial Sequence
  Description of Artificial Sequence: Synthetic peptide
VRIGPGQTFYATGDIIGDIKQAHCNIS

SEQ ID NO: 24 - protein, 27 aa, Artificial Sequence
  Description of Artificial Sequence: Synthetic peptide
QTFYATGDIIGDIKQAHCNISEEKWND

SEQ ID NO: 25 - protein, 27 aa, Artificial Sequence
  Description of Artificial Sequence: Synthetic peptide
QTFYATGDIIGDIKQAHCNISEEKWND

SEQ ID NO: 26 - protein, 47 aa, Artificial Sequence
  Description of Artificial Sequence: Synthetic polypeptide
EIVCTRPGNNTRKSVRIGPGQTFYATGDIIGDIRQAHCNISERQWNK

SEQ ID NO: 27 - protein, 46 aa, Artificial Sequence
  Description of Artificial Sequence: Synthetic polypeptide
EIVCTRPGNNTRKSVRIGPGQTFYATGDIIGDIRQAHCNISERQWN

SEQ ID NO: 28 - protein, 47 aa, Artificial Sequence
  Description of Artificial Sequence: Synthetic polypeptide
EIVCTRPNNNTRKSVRIGPGQTFYATGDIIGDIKQAHCNISEEKWND

SEQ ID NO: 29 - protein, 30 aa, Human immunodeficiency virus 1; identical to SEQ ID NO: 1

SEQ ID NO: 30 - protein, 30 aa, Artificial Sequence
  Description of Artificial Sequence: Synthetic polypeptide
EINCTRPNNNTRPGEIIGAIAQAHCNISRA

SEQ ID NO: 31 - protein, 30 aa, Artificial Sequence; identical to SEQ ID NO: 1
  Description of Artificial Sequence: Synthetic polypeptide

SEQ ID NO: 32 - protein, 30 aa, Artificial Sequence
  Description of Artificial Sequence: Synthetic polypeptide
EINCTRPNNNTRPGEIIGAIRQAHCNISRA

SEQ ID NO: 33 - protein, 30 aa, Artificial Sequence
  Description of Artificial Sequence: Synthetic polypeptide
EINCTRPNNNTRPGEIIADARQAHCNISRA

SEQ ID NO: 34 - protein, 4 aa, Human immunodeficiency virus 1
GDIR

SEQ ID NO: 35 - protein, 4 aa, Artificial Sequence
  Description of Artificial Sequence: Synthetic peptide
GNPR

SEQ ID NO: 36 - protein, 4 aa, Artificial Sequence
  Description of Artificial Sequence: Synthetic peptide
GNIR

SEQ ID NO: 37 - protein, 4 aa, Human immunodeficiency virus 1
REKR

SEQ ID NO: 38 - protein, 9 aa, Human immunodeficiency virus 1
RRVVEREKR

SEQ ID NO: 39 - protein, 9 aa, Artificial Sequence
  Description of Artificial Sequence: Synthetic peptide
ERVVEREKE

SEQ ID NO: 40 - protein, 4 aa, Artificial Sequence
  Description of Artificial Sequence: Synthetic peptide
SEKS

SEQ ID NO: 41 - protein, 33 aa, Artificial Sequence
  Description of Artificial Sequence: Synthetic polypeptide
TRPNNNTRKSIRIGPGQTFYATGDIIGNIRQAH

SEQ ID NO: 42 - protein, 24 aa, Homo sapiens
MPMGSLQPLATLYLLGMLVASVLA

SEQ ID NO: 43 - DNA, 21 bp, Artificial Sequence
  Description of Artificial Sequence: Synthetic primer
tcctcttcttggtggcagcag

SEQ ID NO: 44 - DNA, 21 bp, Artificial Sequence
  Description of Artificial Sequence: Synthetic primer
tacagatctgtcctgtgccct

SEQ ID NO: 45 - DNA, 21 bp, Artificial Sequence
  Description of Artificial Sequence: Synthetic primer
ttctcagccccagcacagctg

SEQ ID NO: 46 - DNA, 26 bp, Artificial Sequence
  Description of Artificial Sequence: Synthetic primer
gggtggcagagtgagactctgtcaca

SEQ ID NO: 47 - DNA, 21 bp, Artificial Sequence
  Description of Artificial Sequence: Synthetic primer
agaggagcccaggatgctgat

SEQ ID NO: 48 - DNA, 21 bp, Artificial Sequence
  Description of Artificial Sequence: Synthetic primer
actctcctcactcaggacaca

SEQ ID NO: 49 - DNA, 21 bp, Artificial Sequence
  Description of Artificial Sequence: Synthetic primer
tctcaaggccgcgctgcagca

SEQ ID NO: 50 - DNA, 21 bp, Artificial Sequence
  Description of Artificial Sequence: Synthetic primer
agctgtccctgtcctggatgg

SEQ ID NO: 51 - protein, 9 aa, Artificial Sequence
  Description of Artificial Sequence: Synthetic peptide
GGGHHHHHH

SEQ ID NO: 52 - DNA, 35 bp, Artificial Sequence
  Description of Artificial Sequence: Synthetic primer
cccagtgtatatagtagccggtgaaggtgtatcca

SEQ ID NO: 53 - DNA, 35 bp, Artificial Sequence
  Description of Artificial Sequence: Synthetic primer
tcgcacccagtgcatatagtagtcggtgaaggtgt

SEQ ID NO: 54 - DNA, 35 bp, Artificial Sequence
  Description of Artificial Sequence: Synthetic primer
gatggatcaaccctaactctggtcgcacaaactat

SEQ ID NO: 55 - DNA, 35 bp, Artificial Sequence
  Description of Artificial Sequence: Synthetic primer
tgtgcatagtttgtgccaccagtgttagggttgat

SEQ ID NO: 56 - DNA, 40 bp, Artificial Sequence
  Description of Artificial Sequence: Synthetic primer
cttctgtgcatagtttgtgacaccagtgttagggttgatc

SEQ ID NO: 57 - DNA, 35 bp, Artificial Sequence
  Description of Artificial Sequence: Synthetic primer
atcaaccctaacagtggtcgcacaaactatgcaca

SEQ ID NO: 58 - protein, 6 aa, Artificial Sequence
  Description of Artificial Sequence: Synthetic 6xHis tag
HHHHHH

SEQ ID NO: 59 - protein, 6 aa, Artificial Sequence
  Description of Artificial Sequence: Synthetic peptide
RRRRRR

SEQ ID NO: 60 - protein, 5 aa, Artificial Sequence
  Description of Artificial Sequence: Synthetic peptide
  MOD_RES (3)..(3): Any amino acid
LPXTG

SEQ ID NO: 61 - protein, 5 aa, Artificial Sequence
  Description of Artificial Sequence: Synthetic peptide
GGGGG

SEQ ID NO: 62 - protein, 127 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVIMTRDTSISTAYMELSRLRSDDTAVYYCARGGWIGLYYDSSGYPNFDYWGQGTLVTVSS

SEQ ID NO: 63 - protein, 127 aa, Artificial Sequence
  Description of Artificial Sequence: Synthetic polypeptide
QVQLVQSGAEVKKPGASVKVSCKASGYTFTDYYIHWVRQAPGQGLEWMGWINPNTGRTNYAQKFQGRVIMTRDTSISTAYMELSRLRSDDTAVYYCARGGWIGLYYDSSGYPNFDYWGQGTLVTVSS

SEQ ID NO: 64 - protein, 127 aa, Artificial Sequence
  Description of Artificial Sequence: Synthetic polypeptide
QVQLVQSGAEVKKPGASVKVSCKASGYTFTDYYIHWVRQAPGQGLEWMAWINPTTGRTNYARKFQGRVIMTRDTSISTAYMELRRLRSDDTAVYYCARGGWIGLYVDYSGYPNFDSWGQGTLVTVSS

SEQ ID NO: 65 - protein, 127 aa, Artificial Sequence
  Description of Artificial Sequence: Synthetic polypeptide
EVQLVESGPELKEPGASVKVSCKASGYTFTDYYIHWVRQAPGQGLEWMAWINPTTGRSSFARGFQGRVIMTRETSVSTAYMELRRLRSDDTAVYYCAKAGYIALYVDYSGYPNFNSWGQGTLVTVSS

SEQ ID NO: 66 - protein, 127 aa, Artificial Sequence
  Description of Artificial Sequence: Synthetic polypeptide
QVQLVQSGAELKKPGASVKVSCKASGYTLSDYYVHWLRQAPGQGLEWVAWINPTSGRTISPRKFQGRVIMTTDTSMNVAYMELRGLRSDDTAVYFCARGGWISLYVDYSYYPNFDSWGQGTLVSVSS

SEQ ID NO: 67 - protein, 127 aa, Artificial Sequence
  Description of Artificial Sequence: Synthetic polypeptide
QVQLVQSGAEMKKPGASVKVSCKASGYTFTDYYIHWVRQAPGQGLEWMGWINPNTGRTNYAQKFQGRVIMTRDTSISTAYMELSRLTSDDTAVYYCATGGWIGLYYDSSGYPNFDYWGQGTLVTVSS

SEQ ID NO: 68 - protein, 127 aa, Artificial Sequence
  Description of Artificial Sequence: Synthetic polypeptide
QVQLVQSGAEMKKPGASVRVSCKASGYTFTDYYIHWVRQAPGQGPEWMGWINPSTGRTNSPQKFQGRVIMTRDTSISTAYMDLNRLTSDDTAMYYCTTGGWIGLYSDTSGYPNFDYWGQGTLVTVSS

SEQ ID NO: 69 - protein, 127 aa, Artificial Sequence
  Description of Artificial Sequence: Synthetic polypeptide
QVQLVQSGAEMKNPGASVKVSCAASGYTFTDFYIHWVRLAPGQGLEWMGWMNPKTGRTNNAQNFQGRVIMTRDTSIGTAYMELRRLTSDDTAVYYCVTGGWISPYYDSSYYPNFDHWGQGTLVTVSS

SEQ ID NO: 70 - protein, 127 aa, Artificial Sequence
  Description of Artificial Sequence: Synthetic polypeptide
EVQLVQSGAEMKNPGASVKVSCAASGYGFTDFYIHWVRLAPGHGLQWMGWMNPKTGRTNNAQDFQGRVILTRDTSIGTAYMELRRLTSDDTAVYYCVTGGWISPYYDSSYYPNFDHWGQGTLITVSS

SEQ ID NO: 71 - protein, 127 aa, Artificial Sequence
  Description of Artificial Sequence: Synthetic polypeptide
QVQLVQSGAEVKNPGASVKVSCAPSGYTFTDFYIHWVRLAPGQGLEWLGWMNPKTGRTNQGQNFQGRVIMTRDTSIGTAYMELRSLTSDDTAVYYCVTGAWISDYYDSSYYPNFDHWGQGTLVTVSS

SEQ ID NO: 72 - protein, 127 aa, Artificial Sequence
  Description of Artificial Sequence: Synthetic polypeptide
QVQLVQSGAQMKNPGASVKVSCAPSGYTFTDFYIHWLRQAPGQGLQWMGWMNPQTGRTNTARNFQGRVIMTRDTSIGTAYMELRSLTSDDTAIYYCTTGGWISLYYDSSYYPNFDHWGQGTLLTVSS

SEQ ID NO: 73 - protein, 110 aa, Artificial Sequence
  Description of Artificial Sequence: Synthetic polypeptide
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTVIFGGGTKLTVL

SEQ ID NO: 74 - protein, 110 aa, Artificial Sequence
  Description of Artificial Sequence: Synthetic polypeptide
QSALTQPASVSGSPGQSITISCTGTSYDVGSYNLVSWYQQHPGKAPKLMIYEVSKRPSGVSNRFSGSKSGNTASLTISGLQAEDEADYYCCSYAGSSTVIFGGGTKLTVL

SEQ ID NO: 75 - protein, 110 aa, Artificial Sequence
  Description of Artificial Sequence: Synthetic polypeptide
QSALTQPASVSGSPGQSITISCTGTSYDVGSYNLVSWYQQHPGKAPKLMIYEVSKWPSGVSNRFSGSKSGNTASLTISGLQAEDEADYYCCSYAGSSTVIFGGGTKLTVL

SEQ ID NO: 76 - protein, 110 aa, Artificial Sequence
  Description of Artificial Sequence: Synthetic polypeptide
QSALTQPASVSGSPGQSITISCTGTSYDVGSYNLVSWYQQHPGKAPKLIIYEVSQWPSGVSKRFSGSKSGNTASLTISGLQAEDEAHYYCCSYAGSSTVIFGGGTSLTVL

SEQ ID NO: 77 - protein, 110 aa, Artificial Sequence
  Description of Artificial Sequence: Synthetic polypeptide
QPVLTQPASVSGSPGQSITISCTGSSSDVGSYNLVSWYQQHPGKAPKLMIYEVNKWASGVSDRFAGSKSGNTASLTISRLQAEDEANYFCSSSTNSATVIFGGGTKLTVL

SEQ ID NO: 78 - protein, 110 aa, Artificial Sequence
  Description of Artificial Sequence: Synthetic polypeptide
QSALTQPASVSGSPGQSITISCTGTSYDVGSYNLVSWYQQHPGKAPKYMIYEVNKRPSGVSNRFSGSKSGNTASLTISGLQAEDEADYYCCSYAGSSTVIFGGGTKLTVL

SEQ ID NO: 79 - protein, 110 aa, Artificial Sequence
  Description of Artificial Sequence: Synthetic polypeptide
QSALTQPASVSGSPGQSITISCTGTNYDVGSYNLVSWYQQHPGKVPKYIIYEVNKRPSGVSNRFSGSKSGNTASLTISGLQAEDEADYYCCSYAGSSIIFFGGGTKLTVI

SEQ ID NO: 80 - protein, 110 aa, Artificial Sequence
  Description of Artificial Sequence: Synthetic polypeptide
QSALTQPASVSGSPGQSITISCTGTSYDVGKFDLVSWYQQHPGKAPKYMIYEVNKWPSGVSHRFSGSKSGNTASLTISGLQAEDEADYYCCSFGGSATVVCGGGTKVTVL

SEQ ID NO: 81 - protein, 110 aa, Artificial Sequence
  Description of Artificial Sequence: Synthetic polypeptide
QSALTQPASVSGSPGQSITISCTGTSYDVAKFDLVSWFQQHPGKAPKYMIYEVNKWPSGVSHRFSGSKSGNTASLTISGLQAEDEADYYCCSFGGSATVVCGGGTKVTVL

SEQ ID NO: 82 - protein, 110 aa, Artificial Sequence
  Description of Artificial Sequence: Synthetic polypeptide
LPVLTQPASVSGSPGQSITISCTGTIYDVGKFDLVSWYQHHPGKAPKYLIYEVKKWPSGVSHRFSGSKSGNTASLTISGLQVEDEADYYCCSFGGSAAVVCGGGTKVTVL

SEQ ID NO: 83 - protein, 110 aa, Artificial Sequence
  Description of Artificial Sequence: Synthetic polypeptide
TSLLTQPASVSGSPGQSITISCTGTKYDVGSHDLVSWYQQYPGKVPKYMIYEVNKRPSGVSNRFSGSKSGNTASLTISGLRAEDEADYYCCSFGGSATVVCGGGTKVTVL

SEQ ID NO: 84 - protein, 96 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYC

SEQ ID NO: 85 - protein, 96 aa, Artificial Sequence
  Description of Artificial Sequence: Synthetic polypeptide
QVQLVQSGAEVKKPGASVKVSCKASGYTFTDYYIHWVRQAPGQGLEWMGWINPNTGRTNYAQKFQGRVTMTRDTSISTAYMELSRLRSDDTAVYYC

SEQ ID NO: 86 - protein, 96 aa, Artificial Sequence
  Description of Artificial Sequence: Synthetic polypeptide
QVQLVQSGAEMKKPGASVKVSCKASGYTFTDYYIHWVRQAPGQGLEWMGWINPNTGRTNYAQKFQGRVTMTRDTSISTAYMELSRLTSDDTAVYYC

SEQ ID NO: 87 - protein, 96 aa, Artificial Sequence
  Description of Artificial Sequence: Synthetic polypeptide
QVQLVQSGAEMKNPGASVKVSCAASGYTFTDFYIHWVRLAPGQGLEWMGWMNPKTGRTNNAQNFQGRVTMTRDTSIGTAYMELRRLTSDDTAVYYC

SEQ ID NO: 88 - protein, 96 aa, Artificial Sequence
  Description of Artificial Sequence: Synthetic polypeptide
QVQLVQSGAEVKKPGASVKVSCKASGYTFTDYYIHWVRQAPGQGLEWMAWINPTTGRTNYARKFQGRVTMTRDTSISTAYMELRRLRSDDTAVYYC

SEQ ID NO: 89 - protein, 96 aa, Artificial Sequence
  Description of Artificial Sequence: Synthetic polypeptide
QVQLVQSGAEMKKPGASVRVSCKASGYTFTDYYIHWVRQAPGQGPEWMGWINPSTGRTNSPQKFQGRVTMTRDTSISTAYMDLNRLTSDDTAMYYC

SEQ ID NO: 90 - protein, 96 aa, Artificial Sequence
  Description of Artificial Sequence: Synthetic polypeptide
QVQLVQSGAELKKPGASVKVSCKASGYTLSDYYVHWLRQAPGQGLEWVAWINPTSGRTISPRKFQGRVTMTTDTSMNVAYMELRGLRSDDTAVYFC

SEQ ID NO: 91 - protein, 96 aa, Artificial Sequence
  Description of Artificial Sequence: Synthetic polypeptide
EVQLVQSGAEMKNPGASVKVSCAASGYGFTDFYIHWVRLAPGHGLQWMGWMNPKTGRTNNAQDFQGRVTLTRDTSIGTAYMELRRLTSDDTAVYYC

SEQ ID NO: 92 - protein, 96 aa, Artificial Sequence
  Description of Artificial Sequence: Synthetic polypeptide
QVQLVQSGAEVKNPGASVKVSCAPSGYTFTDFYIHWVRLAPGQGLEWLGWMNPKTGRTNQGQNFQGRVTMTRDTSIGTAYMELRSLTSDDTAVYYC

SEQ ID NO: 93 - protein, 96 aa, Artificial Sequence
  Description of Artificial Sequence: Synthetic polypeptide
EVQLVESGPELKEPGASVKVSCKASGYTFTDYYIHWVRQAPGQGLEWMAWINPTTGRSSFARGFQGRVTMTRETSVSTAYMELRRLRSDDTAVYYC

SEQ ID NO: 94 - protein, 96 aa, Artificial Sequence
  Description of Artificial Sequence: Synthetic polypeptide
QVQLVQSGAQMKNPGASVKVSCAPSGYTFTDFYIHWLRQAPGQGLQWMGWMNPQTGRTNTARNFQGRVTMTRDTSIGTAYMELRSLTSDDTAIYYC

SEQ ID NO: 95 - protein, 94 aa, Homo sapiens
QVQLVQSGAEVKKPGASVKVSCHASGFRFTDHYINWLRQAPGQEFEWIGWINPNNSVTHYAQKFQARVTMTRFGSTIYMELNRLRSDDTAVYYC

SEQ ID NO: 96 - protein, 96 aa, Homo sapiens
QVQLVQSGGQMKKPGESMRISCRASGYEFIDCTLNWIRLAPGKRPEWMGWLKPRGGAVNYARFLQGRVTMTRDVYSDTAFLELRSLTVDDTAVYFC

SEQ ID NO: 97 - protein, 98 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 98 - protein, 98 aa, Artificial Sequence
  Description of Artificial Sequence: Synthetic polypeptide
QVQLVQSGAEVKKPGASVKVSCKASGYTFTDYYIHWVRQAPGQGLEWMGWINPNTGRTNYAQKFQGRVTMTRDTSISTAYMELSRLRSDDTAVYYCAR

SEQ ID NO: 99 - protein, 98 aa, Artificial Sequence
  Description of Artificial Sequence: Synthetic polypeptide
QVQLVQSGAEMKKPGASVKVSCKASGYTFTDYYIHWVRQAPGQGLEWMGWINPNTGRTNYAQKFQGRVTMTRDTSISTAYMELSRLTSDDTAVYYCAT

SEQ ID NO: 100 - protein, 98 aa, Artificial Sequence
  Description of Artificial Sequence: Synthetic polypeptide
QVQLVQSGAEMKNPGASVKVSCAASGYTFTDFYIHWVRLAPGQGLEWMGWMNPKTGRTNNAQNFQGRVTMTRDTSIGTAYMELRRLTSDDTAVYYCVT

SEQ ID NO: 101 - protein, 98 aa, Artificial Sequence
  Description of Artificial Sequence: Synthetic polypeptide
QVQLVQSGAEVKKPGASVKVSCKASGYTFTDYYIHWVRQAPGQGLEWMAWINPTTGRTNYARKFQGRVTMTRDTSISTAYMELRRLRSDDTAVYYCAR

SEQ ID NO: 102 - protein, 98 aa, Artificial Sequence
  Description of Artificial Sequence: Synthetic polypeptide
QVQLVQSGAEMKKPGASVRVSCKASGYTFTDYYIHWVRQAPGQGPEWMGWINPSTGRTNSPQKFQGRVTMTRDTSISTAYMDLNRLTSDDTAMYYCTT

SEQ ID NO: 103 - protein, 98 aa, Artificial Sequence
  Description of Artificial Sequence: Synthetic polypeptide
QVQLVQSGAELKKPGASVKVSCKASGYTLSDYYVHWLRQAPGQGLEWVAWINPTSGRTISPRKFQGRVTMTTDTSMNVAYMELRGLRSDDTAVYFCAR

SEQ ID NO: 104 - protein, 98 aa, Artificial Sequence
  Description of Artificial Sequence: Synthetic polypeptide
EVQLVQSGAEMKNPGASVKVSCAASGYGFTDFYIHWVRLAPGHGLQWMGWMNPKTGRTNNAQDFQGRVTLTRDTSIGTAYMELRRLTSDDTAVYYCVT

SEQ ID NO: 105 - protein, 98 aa, Artificial Sequence
  Description of Artificial Sequence: Synthetic polypeptide
QVQLVQSGAEVKNPGASVKVSCAPSGYTFTDFYIHWVRLAPGQGLEWLGWMNPKTGRTNQGQNFQGRVTMTRDTSIGTAYMELRSLTSDDTAVYYCVT

SEQ ID NO: 106 - protein, 98 aa, Artificial Sequence
  Description of Artificial Sequence: Synthetic polypeptide
EVQLVESGPELKEPGASVKVSCKASGYTFTDYYIHWVRQAPGQGLEWMAWINPTTGRSSFARGFQGRVTMTRETSVSTAYMELRRLRSDDTAVYYCAK

SEQ ID NO: 107 - protein, 98 aa, Artificial Sequence
  Description of Artificial Sequence: Synthetic polypeptide
QVQLVQSGAQMKNPGASVKVSCAPSGYTFTDFYIHWLRQAPGQGLQWMGWMNPQTGRTNTARNFQGRVTMTRDTSIGTAYMELRSLTVDDTAVYFCTT

SEQ ID NO: 108 - protein, 98 aa, Homo sapiens; identical to SEQ ID NO: 97

SEQ ID NO: 109 - protein, 98 aa, Homo sapiens
QVQLVQSGAEVKKPGASVKVSCKASGYIFTDYYMHWVRQAPGQELGWMGRINPNSGGTNYAQKFQGRVTMTRDTSISTAYTELSSLRSEDTATYYCAR

SEQ ID NO: 110 - protein, 126 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATGGWIGLYYDSSGYPNFDYWGQGTLVTVS

SEQ ID NO: 111 - protein, 126 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGWISLYYDSSGYPNFDYWGQGTLVTVS

SEQ ID NO: 112 - protein, 126 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGWIGLYYDSSGYPNFDYWGQGTLVTVS

SEQ ID NO: 113 - protein, 110 aa, Artificial Sequence; identical to SEQ ID NO: 73
  Description of Artificial Sequence: Synthetic polypeptide

SEQ ID NO: 114 - protein, 110 aa, Artificial Sequence
  Description of Artificial Sequence: Synthetic polypeptide
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSIILFGGGTKLTVL

SEQ ID NO: 115 - protein, 6 aa, Human immunodeficiency virus 1
CNVSKA

SEQ ID NO: 116 - protein, 6 aa, Human immunodeficiency virus 1
CNVSRA

SEQ ID NO: 117 - protein, 6 aa, Human immunodeficiency virus 1
CNVTRS

SEQ ID NO: 118 - protein, 6 aa, Human immunodeficiency virus 1
CNVSRS

SEQ ID NO: 119 - protein, 6 aa, Human immunodeficiency virus 1
CNVSRS

SEQ ID NO: 120 - protein, 6 aa, Human immunodeficiency virus 1
CNVSRS

SEQ ID NO: 121 - protein, 6 aa, Human immunodeficiency virus 1
CNVSGS

SEQ ID NO: 122 - protein, 6 aa, Human immunodeficiency virus 1
CNVSKA

SEQ ID NO: 123 - protein, 6 aa, Human immunodeficiency virus 1
CNVSKS

SEQ ID NO: 124 - protein, 6 aa, Human immunodeficiency virus 1
CNVSGT

SEQ ID NO: 125 - protein, 6 aa, Human immunodeficiency virus 1
CNVSQT

SEQ ID NO: 126 - protein, 6 aa, Human immunodeficiency virus 1
CNVSGS

SEQ ID NO: 127 - protein, 6 aa, Human immunodeficiency virus 1
CNVSRS

SEQ ID NO: 128 - protein, 6 aa, Human immunodeficiency virus 1
CNVSRK

SEQ ID NO: 129 - protein, 6 aa, Human immunodeficiency virus 1
CNVSKT

SEQ ID NO: 130 - protein, 6 aa, Human immunodeficiency virus 1
CNVSGS

SEQ ID NO: 131 - protein, 6 aa, Human immunodeficiency virus 1
CTVNRT

SEQ ID NO: 132 - protein, 6 aa, Human immunodeficiency virus 1
CKVNRS

SEQ ID NO: 133 - protein, 6 aa, Human immunodeficiency virus 1
CNVNRT

SEQ ID NO: 134 - protein, 6 aa, Human immunodeficiency virus 1
CTVNRT

SEQ ID NO: 135 - protein, 6 aa, Human immunodeficiency virus 1
CHVNKT

SEQ ID NO: 136 - protein, 6 aa, Human immunodeficiency virus 1
CVVNRT

SEQ ID NO: 137 - protein, 6 aa, Human immunodeficiency virus 1
CIVNKT

SEQ ID NO: 138 - protein, 6 aa, Human immunodeficiency virus 1
CTVNRT

SEQ ID NO: 139 - protein, 6 aa, Human immunodeficiency virus 1
CVVNRT

SEQ ID NO: 140 - protein, 6 aa, Human immunodeficiency virus 1
CTVSKA

SEQ ID NO: 141 - protein, 6 aa, Human immunodeficiency virus 1
CNVNRQ

SEQ ID NO: 142 - protein, 6 aa, Human immunodeficiency virus 1
CNVNRQ

SEQ ID NO: 143 - protein, 6 aa, Human immunodeficiency virus 1
CNISRT

SEQ ID NO: 144 - protein, 6 aa, Human immunodeficiency virus 1
CEINGT

SEQ ID NO: 145 - protein, 6 aa, Human immunodeficiency virus 1
CEINGT

SEQ ID NO: 146 - protein, 6 aa, Human immunodeficiency virus 1
CEINGT

SEQ ID NO: 147 - protein, 6 aa, Human immunodeficiency virus 1
CEINGT

SEQ ID NO: 148 - protein, 6 aa, Human immunodeficiency virus 1
CEINET

SEQ ID NO: 149 - protein, 6 aa, Human immunodeficiency virus 1
CEINRT

SEQ ID NO: 150 - protein, 6 aa, Human immunodeficiency virus 1
CEINGT

SEQ ID NO: 151 - protein, 6 aa, Human immunodeficiency virus 1
CEINGT

SEQ ID NO: 152 - protein, 6 aa, Human immunodeficiency virus 1
CKINGT

SEQ ID NO: 153 - protein, 6 aa, Human immunodeficiency virus 1
CVINGT

SEQ ID NO: 154 - protein, 6 aa, Human immunodeficiency virus 1
CKINAT

SEQ ID NO: 155 - protein, 6 aa, Human immunodeficiency virus 1
CEINGT

SEQ ID NO: 156 - protein, 6 aa, Human immunodeficiency virus 1
CEINGT

SEQ ID NO: 157 - protein, 6 aa, Human immunodeficiency virus 1
CEINRT

SEQ ID NO: 158 - protein, 6 aa, Human immunodeficiency virus 1
CEINGT

SEQ ID NO: 159 - protein, 6 aa, Human immunodeficiency virus 1
CEINRT

SEQ ID NO: 160 - protein, 6 aa, Human immunodeficiency virus 1
CEINQT

SEQ ID NO: 161 - protein, 6 aa, Human immunodeficiency virus 1
CEINET

SEQ ID NO: 162 - protein, 6 aa, Human immunodeficiency virus 1
CKINGT

SEQ ID NO: 163 - protein, 6 aa, Human immunodeficiency virus 1
CEINGA

SEQ ID NO: 164 - protein, 6 aa, Human immunodeficiency virus 1
CEIDGT

SEQ ID NO: 165 - protein, 6 aa, Human immunodeficiency virus 1
CEIDGT

SEQ ID NO: 166 - protein, 6 aa, Human immunodeficiency virus 1
CNVSRS

SEQ ID NO: 167 - protein, 6 aa, Human immunodeficiency virus 1
CNVSTT

SEQ ID NO: 168 - protein, 6 aa, Human immunodeficiency virus 1
CNVSST

SEQ ID NO: 169 - protein, 6 aa, Human immunodeficiency virus 1
CNVSGK

SEQ ID NO: 170 - protein, 6 aa, Human immunodeficiency virus 1
CNVSKG

SEQ ID NO: 171 - protein, 6 aa, Human immunodeficiency virus 1
CNVSKI

SEQ ID NO: 172 - protein, 6 aa, Human immunodeficiency virus 1
CNVSRG

SEQ ID NO: 173 - protein, 6 aa, Human immunodeficiency virus 1
CNVSGT

SEQ ID NO: 174 - protein, 6 aa, Human immunodeficiency virus 1
CNVSKR

SEQ ID NO: 175 - protein, 5 aa, Human immunodeficiency virus 1
CNVSK

SEQ ID NO: 176 - protein, 6 aa, Human immunodeficiency virus 1
CNVSKT

SEQ ID NO: 177 - protein, 6 aa, Human immunodeficiency virus 1
CEVNRT

SEQ ID NO: 178 - protein, 6 aa, Human immunodeficiency virus 1
CVVNKT

SEQ ID NO: 179 - protein, 6 aa, Human immunodeficiency virus 1
CKVNKT

SEQ ID NO: 180 - protein, 6 aa, Human immunodeficiency virus 1
CEVNRT

SEQ ID NO: 181 - protein, 6 aa, Human immunodeficiency virus 1
CNISGK

SEQ ID NO: 182 - protein, 4 aa, Human immunodeficiency virus 1
CNIS

SEQ ID NO: 183 - protein, 6 aa, Human immunodeficiency virus 1
CNISET

SEQ ID NO: 184 - protein, 6 aa, Human immunodeficiency virus 1
CNISRD

SEQ ID NO: 185 - protein, 6 aa, Human immunodeficiency virus 1
CNISKD

SEQ ID NO: 186 - protein, 6 aa, Human immunodeficiency virus 1
CNISEN

SEQ ID NO: 187 - protein, 6 aa, Human immunodeficiency virus 1
CNINRT

SEQ ID NO: 188 - protein, 6 aa, Human immunodeficiency virus 1
CNISGE

SEQ ID NO: 189 - protein, 6 aa, Human immunodeficiency virus 1
CNLSRT

SEQ ID NO: 190 - protein, 6 aa, Human immunodeficiency virus 1
CNISRT

SEQ ID NO: 191 - protein, 6 aa, Human immunodeficiency virus 1
CNISRA

SEQ ID NO: 192 - protein, 6 aa, Human immunodeficiency virus 1
CNISRK

SEQ ID NO: 193 - protein, 6 aa, Human immunodeficiency virus 1
CNISGE

SEQ ID NO: 194 - protein, 6 aa, Human immunodeficiency virus 1
CNISRT

SEQ ID NO: 195 - protein, 6 aa, Human immunodeficiency virus 1
CNISKA

SEQ ID NO: 196 - protein, 6 aa, Human immunodeficiency virus 1
CNISRA

SEQ ID NO: 197 - protein, 6 aa, Human immunodeficiency virus 1
CNISRG

SEQ ID NO: 198 - protein, 6 aa, Human immunodeficiency virus 1
CNLSRA

SEQ ID NO: 199 - protein, 6 aa, Human immunodeficiency virus 1
CNLSIA

SEQ ID NO: 200 - protein, 6 aa, Human immunodeficiency virus 1
CNLSRA

SEQ ID NO: 201 - protein, 6 aa, Human immunodeficiency virus 1
CNISRT

SEQ ID NO: 202 - protein, 6 aa, Human immunodeficiency virus 1
CNLSRA

SEQ ID NO: 203 - protein, 6 aa, Human immunodeficiency virus 1
CNISRA

SEQ ID NO: 204 - protein, 6 aa, Human immunodeficiency virus 1
CNLSRA

SEQ ID NO: 205 - protein, 6 aa, Human immunodeficiency virus 1
CNISRE

SEQ ID NO: 206 - protein, 6 aa, Human immunodeficiency virus 1
CNLSRA

SEQ ID NO: 207 - protein, 6 aa, Human immunodeficiency virus 1
CNISRT

SEQ ID NO: 208 - protein, 6 aa, Human immunodeficiency virus 1
CNLSKT

SEQ ID NO: 209 - protein, 6 aa, Human immunodeficiency virus 1
CNLSSA

SEQ ID NO: 210 - protein, 6 aa, Human immunodeficiency virus 1
CNISAT

SEQ ID NO: 211 - protein, 6 aa, Human immunodeficiency virus 1
CNISRA

SEQ ID NO: 212 - protein, 6 aa, Human immunodeficiency virus 1
CNISRQ

SEQ ID NO: 213 - protein, 6 aa, Human immunodeficiency virus 1
CNLSSV

SEQ ID NO: 214 - protein, 6 aa, Human immunodeficiency virus 1
CNISEA

SEQ ID NO: 215 - protein, 6 aa, Human immunodeficiency virus 1
CNLSST

SEQ ID NO: 216 - protein, 6 aa, Human immunodeficiency virus 1
CNLSRA

SEQ ID NO: 217 - protein, 6 aa, Human immunodeficiency virus 1
CNLSRT

SEQ ID NO: 218 - protein, 6 aa, Human immunodeficiency virus 1
CNLSRA

SEQ ID NO: 219 - protein, 6 aa, Human immunodeficiency virus 1
CNLSRT

SEQ ID NO: 220 - protein, 6 aa, Human immunodeficiency virus 1
CNISTE

SEQ ID NO: 221 - protein, 6 aa, Human immunodeficiency virus 1
CNISRA

SEQ ID NO: 222 - protein, 6 aa, Human immunodeficiency virus 1
CNISRA

SEQ ID NO: 223 - protein, 6 aa, Human immunodeficiency virus 1
CNISRA

SEQ ID NO: 224 - protein, 6 aa, Human immunodeficiency virus 1
CTINES

SEQ ID NO: 225 - protein, 6 aa, Human immunodeficiency virus 1
CTLNST

SEQ ID NO: 226 - protein, 6 aa, Human immunodeficiency virus 1
CNVNKT

SEQ ID NO: 227 - protein, 6 aa, Human immunodeficiency virus 1
CTVNGT

SEQ ID NO: 228 - protein, 6 aa, Human immunodeficiency virus 1
CNINRA

SEQ ID NO: 229 - protein, 6 aa, Human immunodeficiency virus 1
CNISRK

SEQ ID NO: 230 - protein, 6 aa, Human immunodeficiency virus 1
CNVSRV

SEQ ID NO: 231 - protein, 6 aa, Human immunodeficiency virus 1
CNVSKV

SEQ ID NO: 232 - protein, 6 aa, Human immunodeficiency virus 1
CNISGA

SEQ ID NO: 233 - protein, 6 aa, Human immunodeficiency virus 1
CNISRK

SEQ ID NO: 234 - protein, 6 aa, Human immunodeficiency virus 1
CNISGE

SEQ ID NO: 235 - protein, 6 aa, Human immunodeficiency virus 1
CNVSRT

SEQ ID NO: 236 - protein, 6 aa, Human immunodeficiency virus 1
CNISEA

SEQ ID NO: 237 - protein, 6 aa, Human immunodeficiency virus 1
CEINGT

SEQ ID NO: 238 - protein, 6 aa, Human immunodeficiency virus 1
CTIDGT

SEQ ID NO: 239 - protein, 6 aa, Human immunodeficiency virus 1
CNISKS

SEQ ID NO: 240 - protein, 6 aa, Human immunodeficiency virus 1
CNVTRG

SEQ ID NO: 241 - protein, 6 aa, Human immunodeficiency virus 1
CNISGT

SEQ ID NO: 242 - protein, 6 aa, Human immunodeficiency virus 1
CNISKT

SEQ ID NO: 243 - protein, 6 aa, Human immunodeficiency virus 1
CNISGA

SEQ ID NO: 244 - protein, 6 aa, Human immunodeficiency virus 1
CNISKT

SEQ ID NO: 245 - protein, 6 aa, Human immunodeficiency virus 1
CNINGS

SEQ ID NO: 246 - protein, 6 aa, Human immunodeficiency virus 1
CNISRG

SEQ ID NO: 247 - protein, 6 aa, Human immunodeficiency virus 1
CNISAT

SEQ ID NO: 248 - protein, 6 aa, Human immunodeficiency virus 1
CNVSKA

SEQ ID NO: 249 - protein, 6 aa, Human immunodeficiency virus 1
CNISRE

SEQ ID NO: 250 - protein, 6 aa, Human immunodeficiency virus 1
CNVSRA

SEQ ID NO: 251 - protein, 6 aa, Human immunodeficiency virus 1
CNISKD

SEQ ID NO: 252 - protein, 6 aa, Human immunodeficiency virus 1
CNVSRT

SEQ ID NO: 253 - protein, 4 aa, Human immunodeficiency virus 1
CNIS

SEQ ID NO: 254 - protein, 6 aa, Human immunodeficiency virus 1
CNISRS

SEQ ID NO: 255 - protein, 6 aa, Human immunodeficiency virus 1
CNISSK

SEQ ID NO: 256 - protein, 6 aa, Human immunodeficiency virus 1
CNVSGT

SEQ ID NO: 257 - protein, 6 aa, Human immunodeficiency virus 1
CNINGT

SEQ ID NO: 258 - protein, 6 aa, Human immunodeficiency virus 1
CTVNRT

SEQ ID NO: 259 - protein, 6 aa, Human immunodeficiency virus 1
CTVNRT

SEQ ID NO: 260 - protein, 6 aa, Human immunodeficiency virus 1
CTVNKT

SEQ ID NO: 261 - protein, 6 aa, Human immunodeficiency virus 1
CTINKT

SEQ ID NO: 262 - protein, 6 aa, Human immunodeficiency virus 1
CTVNGS

SEQ ID NO: 263 - protein, 6 aa, Human immunodeficiency virus 1
CSINAG

SEQ ID NO: 264 - protein, 6 aa, Human immunodeficiency virus 1
CNISRT

SEQ ID NO: 265 - protein, 6 aa, Human immunodeficiency virus 1
CNISES

SEQ ID NO: 266 - protein, 6 aa, Human immunodeficiency virus 1
CNISRE

SEQ ID NO: 267 - protein, 6 aa, Human immunodeficiency virus 1
CNISEE

SEQ ID NO: 268 - protein, 6 aa, Human immunodeficiency virus 1
CNISAS

SEQ ID NO: 269 - protein, 6 aa, Human immunodeficiency virus 1
CNISEI

SEQ ID NO: 270 - protein, 6 aa, Human immunodeficiency virus 1
CNISTI

SEQ ID NO: 271 - protein, 6 aa, Human immunodeficiency virus 1
CNISIE

SEQ ID NO: 272 - protein, 6 aa, Human immunodeficiency virus 1
CNISGD

SEQ ID NO: 273 - protein, 6 aa, Human immunodeficiency virus 1
CNISEG

SEQ ID NO: 274 - protein, 6 aa, Human immunodeficiency virus 1
CNISRN

SEQ ID NO: 275 - protein, 6 aa, Human immunodeficiency virus 1
CNISAR

SEQ ID NO: 276 - protein, 6 aa, Human immunodeficiency virus 1
CNVSKQ

SEQ ID NO: 277 - protein, 6 aa, Human immunodeficiency virus 1
CNISGA

SEQ ID NO: 278 - protein, 6 aa, Human immunodeficiency virus 1
CNISES

SEQ ID NO: 279 - protein, 6 aa, Human immunodeficiency virus 1
CNISEK

SEQ ID NO: 280 - protein, 6 aa, Human immunodeficiency virus 1
CNISKT

SEQ ID NO: 281 - protein, 6 aa, Human immunodeficiency virus 1
CNISRE

SEQ ID NO: 282 - protein, 6 aa, Human immunodeficiency virus 1
CNISRT

SEQ ID NO: 283 - protein, 6 aa, Human immunodeficiency virus 1
CNISEA

SEQ ID NO: 284 - protein, 6 aa, Human immunodeficiency virus 1
CNISEK

SEQ ID NO: 285 - protein, 6 aa, Human immunodeficiency virus 1
CNITRN

SEQ ID NO: 286 - protein, 6 aa, Human immunodeficiency virus 1
CNISKD

SEQ ID NO: 287 - protein, 6 aa, Human immunodeficiency virus 1
CNISKD

SEQ ID NO: 288 - protein, 6 aa, Human immunodeficiency virus 1
CNISGE

SEQ ID NO: 289 - protein, 6 aa, Human immunodeficiency virus 1
CNITKS

SEQ ID NO: 290 - protein, 6 aa, Human immunodeficiency virus 1
CNISRN

SEQ ID NO: 291 - protein, 6 aa, Human immunodeficiency virus 1
CNISKK

SEQ ID NO: 292 - protein, 6 aa, Human immunodeficiency virus 1
CNISTD

SEQ ID NO: 293 - protein, 6 aa, Human immunodeficiency virus 1
CNISES

SEQ ID NO: 294 - protein, 6 aa, Human immunodeficiency virus 1
CNISRK

SEQ ID NO: 295 - protein, 6 aa, Human immunodeficiency virus 1
CNISKD

SEQ ID NO: 296 - protein, 6 aa, Human immunodeficiency virus 1
CNTSGL

SEQ ID NO: 297 - protein, 6 aa, Human immunodeficiency virus 1
CNISKV

SEQ ID NO: 298 - protein, 6 aa, Human immunodeficiency virus 1
CNISEE

SEQ ID NO: 299 - protein, 6 aa, Human immunodeficiency virus 1
CNISRD

SEQ ID NO: 300 - protein, 6 aa, Human immunodeficiency virus 1
CNISEA

SEQ ID NO: 301 - protein, 6 aa, Human immunodeficiency virus 1
CNISKS

SEQ ID NO: 302 - protein, 6 aa, Human immunodeficiency virus 1
CNISKH

SEQ ID NO: 303 - protein, 6 aa, Human immunodeficiency virus 1
CNIDKG

SEQ ID NO: 304 - protein, 6 aa, Human immunodeficiency virus 1
CNISEK

SEQ ID NO: 305 - protein, 6 aa, Human immunodeficiency virus 1
CNISAS

SEQ ID NO: 306 - protein, 6 aa, Human immunodeficiency virus 1
CNISKE

SEQ ID NO: 307 - protein, 6 aa, Human immunodeficiency virus 1
CNISRE

SEQ ID NO: 308 - protein, 6 aa, Human immunodeficiency virus 1
CNISEE

SEQ ID NO: 309 - protein, 6 aa, Human immunodeficiency virus 1
CNISRS

SEQ ID NO: 310 - protein, 6 aa, Human immunodeficiency virus 1
CNISEE

SEQ ID NO: 311 - protein, 6 aa, Human immunodeficiency virus 1
CNISKE

SEQ ID NO: 312 - protein, 6 aa, Human immunodeficiency virus 1
CKINGS

SEQ ID NO: 313 - protein, 6 aa, Human immunodeficiency virus 1
CNISKG

SEQ ID NO: 314 - protein, 6 aa, Human immunodeficiency virus 1
CNISEK

SEQ ID NO: 315 - protein, 6 aa, Human immunodeficiency virus 1
CNINNS

SEQ ID NO: 316 - protein, 6 aa, Human immunodeficiency virus 1
CNINES

SEQ ID NO: 317 - protein, 6 aa, Human immunodeficiency virus 1
CKINGT

SEQ ID NO: 318 - protein, 6 aa, Human immunodeficiency virus 1
CTIETE

SEQ ID NO: 319 - protein, 6 aa, Human immunodeficiency virus 1
CIINKA

SEQ ID NO: 320 - protein, 6 aa, Human immunodeficiency virus 1
CNIKKD

SEQ ID NO: 321 - protein, 6 aa, Human immunodeficiency virus 1
CDISED

SEQ ID NO: 322 - protein, 6 aa, Human immunodeficiency virus 1
CDLSKS

SEQ ID NO: 323 - protein, 646 aa, Artificial Sequence
  Description of Artificial Sequence: Synthetic polypeptide
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGCKRRVVERRRRRRAAGLGALFLGFLGAAGSTMGAASITLTVQARQLLSGIVQQQSNLLRAIEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 324 - protein, 646 aa, Artificial Sequence
  Description of Artificial Sequence: Synthetic polypeptide
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVEIQPLGIAPTGCKRRVVERRRRRRAAGLGALFLGFLGAAGSTMGAASITLTVQARQLLSGIVQQQSNLLRAIEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 325 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 326 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 327 - protein, 850 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 328 - protein, 487 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKE

SEQ ID NO: 329 - DNA, 1941 bp, Artificial Sequence
  Description of Artificial Sequence: Synthetic polynucleotide
atgggctccctgcagcccctggccaccctgtacctgctgggcatgctggtggcctccgtgctggccaagggcaagctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtggagatccagcccctgggcatcgcccccaccggctgcaagcgccgcgtggtggagcgccgccgccgccgccgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgctgcaccaacgtgccctggaacacctcctggtccaacaagtccgagaccgacatctgggacaacatgacctggatgcagtgggagcgcgagatctccaactacaccgagaccatctacaagctgctggaggactcccagaaccagcaggagcgcaacgagcaggacctgctggccctggactga

SEQ ID NO: 330 - DNA, 1941 bp, Artificial Sequence
  Description of Artificial Sequence: Synthetic polynucleotide
atgggctccctgcagcccctggccaccctgtacctgctgggcatgctggtggcctccgtgctggccaagggcaagctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtggagatccagcccctgggcatcgcccccaccggctgcaagcgccgcgtggtggagcgccgccgccgccgccgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgctgcaccaacgtgccctggaacacctcctggtccaacaagtccgagaccgacatctgggacaacatgacctggatgcagtgggagcgcgagatctccaactacaccgagaccatctacaagctgctggaggactcccagaaccagcaggagcgcaacgagcaggacctgctggccctggactga

SEQ ID NO: 331 - DNA, 1947 bp, Artificial Sequence
  Description of Artificial Sequence: Synthetic polynucleotide
gccaccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactga

SEQ ID NO: 332 - DNA, 1941 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactga

SEQ ID NO: 333 - DNA, 2556 bp, Artificial Sequence
  Description of Artificial Sequence: Synthetic polynucleotide
atgcgcgtgatgggcatcctcaagaactacccgcagtggtggatctggggcatcctgggcttctggatgctcatgatctgcaacggcaagggcaagctctgggtgacggtctactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaacgggacggtggaggagatgaagaactgctccttcaacacgacgacggagatccgcgacaaggagaagaaggagtacgccctgttctacaagccggacatcgtgccgctgtcggagacgaacaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaactcatccaggggttctgccgcgccatccgcaacatccccacccgcatccgccagggcttcgaggcctcgctcctgtagtaa

SEQ ID NO: 334 - DNA, 1467 bp, Artificial Sequence
  Description of Artificial Sequence: Synthetic polynucleotide
atgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaacgggacggtggaggagatgaagaactgctccttcaacacgacgacggagatccgcgacaaggagaagaaggagtacgccctgttctacaagccggacatcgtgccgctgtcggagacgaacaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaa

SEQ ID NO: 335 - protein, 849 aa, Artificial Sequence
  Description of Artificial Sequence: Synthetic polypeptide
MGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 336 - protein, 486 aa, Artificial Sequence
  Description of Artificial Sequence: Synthetic polypeptide
MGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKE

SEQ ID NO: 337 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 338 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSACTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRCMYAPPIAGNITCKSNITGLLLTRDGGTNSSGKEEIFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 339 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKKVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQWFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 340 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVRNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQWFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 341 - protein, 854 aa, Artificial Sequence
  Description of Artificial Sequence: Synthetic polypeptide
MRVMGIPKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFNTIAIAVAEGTDRIIKVIQRFCRAIRNIPTRIRQGFEASLL

SEQ ID NO: 342 - protein, 491 aa, Artificial Sequence
  Description of Artificial Sequence: Synthetic polypeptide
MRVMGIPKNYPQWWIWGILGFWMLMICNGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 343 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 344 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSACTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRCMYAPPIAGNITCKSNITGLLLTRDGGTKNNSNEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 345 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQWFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 346 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQWFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 347 - protein, 851 aa, Artificial Sequence
  Description of Artificial Sequence: Synthetic polypeptide
MRVMGILKNYPQWWIWGILGFWMLMICNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLLDTIAIAVAEGTDRIIGVIQRVCRAIRNIPTRIRQGFEASLL

SEQ ID NO: 348 - protein, 488 aa, Artificial Sequence
  Description of Artificial Sequence: Synthetic polypeptide
MRVMGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVEIQPLGIAPTGAKERVVEREKE

SEQ ID NO: 349 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 350 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSACTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRCMYAPPIAGNITCRSNITGLLLTRDGGTNSSKTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 351 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKKVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQWFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 352 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVRNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQWFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 353 - protein, 857 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 354 - protein, 494 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKE

SEQ ID NO: 355 - protein, 655 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 356 - protein, 655 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSACTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRCMYAPPIAGNITCRSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 357 - protein, 655 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQWFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 358 - protein, 655 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVRNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQWFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 359 - protein, 866 aa, Artificial Sequence
  Description of Artificial Sequence: Synthetic polypeptide
MKVMGILKNYPQWWIWGILGFWMLMICKGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRNRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 360 - protein, 503 aa, Artificial Sequence
  Description of Artificial Sequence: Synthetic polypeptide
MKVMGILKNYPQWWIWGILGFWMLMICKGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVEIQPLGIAPTGAKERVVEREKE

SEQ ID NO: 361 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 362 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSACTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRCMYAPPIAGNITCKSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 363 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQWFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 364 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVRNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQWFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 365 - protein, 864 aa, Artificial Sequence
  Description of Artificial Sequence: Synthetic polypeptide
MRVTGILRNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQNLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLLDTIAIAVAEGTDRIIEAIQGFCRAIRNIPRRIRQGFEASLL

SEQ ID NO: 366 - protein, 501 aa, Artificial Sequence
  Description of Artificial Sequence: Synthetic polypeptide
MRVTGILRNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVEVQPLGIAPTGAKERVVEREKE

SEQ ID NO: 367 - protein, 662 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 368 - protein, 662 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSACTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRCMYAPPIAGNITCKSNITGLLLTRDGGPDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 369 - protein, 662 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKKVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQWFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 370 - protein, 662 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVRNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQWFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 371 - DNA, 2550 bp, Artificial Sequence
  Description of Artificial Sequence: Synthetic polynucleotide
atgggcatcctgaagaactacccccagtggtggatctggggcatcctgggcttctggatgctgatgatctgcaacggcgagggcaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaactccaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatccgccaggcccactgcaacatctccgagtccaagtggaacgagaccctgcagaaggtgggcaaggagctgcagaagcacttccccaacaagaccatcaagtacgcccagtccgccggcggcgacatggagatcaccacccactccttcaactgcggcggcgagttcttctactgcaacaccgccaagctgttcaacggcacctacaacggcaccgacatctccaccaactcctccaccaactccaaccccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactcctccggcaaggaggagatcttccgccccgccggcggcgacatgcgcgacaactggcgctccgagctgtacaagtacaaggtggtggagatccagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaacgtgccctggaacacctcctggtccaacaagtccgagaccgacatctgggacaacatgacctggatgcagtgggagcgcgagatctccaactacaccgagaccatctacaagctgctggaggactcccagaaccagcaggagcgcaacgagcaggacctgctggccctggactcctggaactccctgtggaactggttcaacatcaccaagtggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgggcggcatcgaggaggagggcggcgagcaggaccgcgaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcgacaccctggccatcgccgtggccgagggcaccgaccgcatcatcgagctgatccagggcttctgccgcgccatccgcaacatccccacccgcatccgccagggcttcgaggcctccctgctgtag

SEQ ID NO: 372 - DNA, 1461 bp, Artificial Sequence
  Description of Artificial Sequence: Synthetic polynucleotide
atgggcatcctgaagaactacccccagtggtggatctggggcatcctgggcttctggatgctgatgatctgcaacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaactccaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatccgccaggcccactgcaacatctccgagtccaagtggaacgagaccctgcagaaggtgggcaaggagctgcagaagcacttccccaacaagaccatcaagtacgcccagtccgccggcggcgacatggagatcaccacccactccttcaactgcggcggcgagttcttctactgcaacaccgccaagctgttcaacggcacctacaacggcaccgacatctccaccaactcctccaccaactccaaccccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactcctccggcaaggaggagatcttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 373 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaactccaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatccgccaggcccactgcaacatctccgagtccaagtggaacgagaccctgcagaaggtgggcaaggagctgcagaagcacttccccaacaagaccatcaagtacgcccagtccgccggcggcgacatggagatcaccacccactccttcaactgcggcggcgagttcttctactgcaacaccgccaagctgttcaacggcacctacaacggcaccgacatctccaccaactcctccaccaactccaaccccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactcctccggcaaggaggagatcttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 374 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaactccaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatccgccaggcccactgcaacatctccgagtccaagtggaacgagaccctgcagaaggtgggcaaggagctgcagaagcacttccccaacaagaccatcaagtacgcccagtccgccggcggcgacatggagatcaccacccactccttcaactgcggcggcgagttcttctactgcaacaccgccaagctgttcaacggcacctacaacggcaccgacatctccaccaactcctccaccaactccaaccccaccatcaccctgcagtgccgcatcaagcagatcatcaacatgtggcagggcgtgggccgctgcatgtacgccccccccatcgccggcaacatcacctgcaagtccaacatcaccggcctgctgctgacccgcgacggcggcaccaactcctccggcaaggaggagatcttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 375 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaagaaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaactccaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgacatccgccaggcccactgcaacatctccgagtccaagtggaacgagaccctgcagaaggtgggcaaggagctgcagaagcacttccccaacaagaccatcaagtacgcccagtccgccggcggcgacatggagatcaccacccactccttcaactgcggcggcgagttcttctactgcaacaccgccaagctgttcaacggcacctacaacggcaccgacatctccaccaactcctccaccaactccaaccccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactcctccggcaaggaggagatcttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 376 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcgcaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaactccaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgacatccgccaggcccactgcaacatctccgagtccaagtggaacgagaccctgcagaaggtgggcaaggagctgcagaagcacttccccaacaagaccatcaagtacgcccagtccgccggcggcgacatggagatcaccacccactccttcaactgcggcggcgagttcttctactgcaacaccgccaagctgttcaacggcacctacaacggcaccgacatctccaccaactcctccaccaactccaaccccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactcctccggcaaggaggagatcttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 377 - DNA, 2565 bp, Artificial Sequence
  Description of Artificial Sequence: Synthetic polynucleotide
atgcgcgtgatgggcatccccaagaactacccccagtggtggatctggggcatcctgggcttctggatgctgatgatctgcaacggcaagggcaagctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgcccgctccaacgtgaacgtgacctccatcaacaacaccatcatgggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagggccagtggaacaagaccctgcacgaggtgtccaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatcaacacctcctccacctcctacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgaggagaccttccgccccgccggcggcgacatgcgcgacaactggcgctccgagctgtacaagtacaaggtggtggagatccagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaccgtgccctggaacacctcctggtccaacaagtccgagaaggacatctgggacaacatgacctggatgcagtgggagcgcgagatctccaactacaccgagaccatctacaccctgctggaggactcccagcgccagcaggagcgcaacgagaaggacctgctggccctggactcctggaactccctgtggaactggttcaacatcaccaactggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgggcggcatcgaggaggagggcggcgagcaggaccgcgaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcaacaccatcgccatcgccgtggccgagggcaccgaccgcatcatcaaggtgatccagcgcttctgccgcgccatccgcaacatccccacccgcatccgccagggcttcgaggcctccctgctgtag

SEQ ID NO: 378 - DNA, 1476 bp, Artificial Sequence
  Description of Artificial Sequence: Synthetic polynucleotide
atgcgcgtgatgggcatccccaagaactacccccagtggtggatctggggcatcctgggcttctggatgctgatgatctgcaacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgcccgctccaacgtgaacgtgacctccatcaacaacaccatcatgggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagggccagtggaacaagaccctgcacgaggtgtccaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatcaacacctcctccacctcctacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 379 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgcccgctccaacgtgaacgtgacctccatcaacaacaccatcatgggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagggccagtggaacaagaccctgcacgaggtgtccaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatcaacacctcctccacctcctacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 380 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgcccgctccaacgtgaacgtgacctccatcaacaacaccatcatgggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgcctgcacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagggccagtggaacaagaccctgcacgaggtgtccaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatcaacacctcctccacctcctacatcaccctgcagtgccgcatcaagcagatcatcaacatgtggcagggcgtgggccgctgcatgtacgccccccccatcgccggcaacatcacctgcaagtccaacatcaccggcctgctgctgacccgcgacggcggcaccaagaacaactccaacgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 381 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgacccctccccccaggagctggtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgcccgctccaacgtgaacgtgacctccatcaacaacaccatcatgggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagtggttctacgccaccggcgacatcatcggcgacatccgccaggcccactgcaacatctccgagggccagtggaacaagaccctgcacgaggtgtccaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatcaacacctcctccacctcctacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 382 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgacccctccccccaggagctggtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgcccgctccaacgtgaacgtgacctccatcaacaacaccatcatgggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagtggttctacgccaccggcgacatcatcggcgacatccgccaggcccactgcaacatctccgagggccagtggaacaagaccctgcacgaggtgtccaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatcaacacctcctccacctcctacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 383 - DNA, 2556 bp, Artificial Sequence
  Description of Artificial Sequence: Synthetic polynucleotide
atgcgcgtgatgggcatcctgaagaactacccccagtggtggatctggggcatcctgggcttctggatgctgatgatctgcaacggcaaggagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaaccgcaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacccccgtggagatcgtgtgcacccgccccaacaacaacacccgcaagtccgtgcgcatcggccccggccagaccttctacgccaccggcgacatcatcggcgacatccgccaggcccactgcaacatctccgagaaggagtggaacgacaccctgcagaaggtgggcaaggagctgcagaagcacttccccaacaagaccatcgagtacaagcagtccgccggcggcgacatggagatcaccacccactccttcaactgcggcggcgagttcttctactgcaacacctccaacctgttcaacggcacctacaacggcacctacatgaacatctccaccgactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactcctccaagaccgaggaggagaccttccgccccgccggcggcgacatgcgcgacaactggcgctccgagctgtacaagtacaaggtggtggagatccagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaacgtgccctggaacacctcctggtccaacaagtccgagaaggacatctgggacaacatgacctggatgcagtgggagcgcgagatctccaactacaccgagaccatctacaagctgctggaggactcccagaaccagcaggagcgcaacgagcaggacctgctggccctggactcctggaactccctgtggaactggttcaacatcaccaagtggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgcgcggcatcgaggaggagggcggcgagcaggaccgcgaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgctggacaccatcgccatcgccgtggccgagggcaccgaccgcatcatcggcgtgatccagcgcgtgtgccgcgccatccgcaacatccccacccgcatccgccagggcttcgaggcctccctgctgtag

SEQ ID NO: 384 - DNA, 1467 bp, Artificial Sequence
  Description of Artificial Sequence: Synthetic polynucleotide
atgcgcgtgatgggcatcctgaagaactacccccagtggtggatctggggcatcctgggcttctggatgctgatgatctgcaacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaaccgcaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacccccgtggagatcgtgtgcacccgccccaacaacaacacccgcaagtccgtgcgcatcggccccggccagaccttctacgccaccggcgacatcatcggcgacatccgccaggcccactgcaacatctccgagaaggagtggaacgacaccctgcagaaggtgggcaaggagctgcagaagcacttccccaacaagaccatcgagtacaagcagtccgccggcggcgacatggagatcaccacccactccttcaactgcggcggcgagttcttctactgcaacacctccaacctgttcaacggcacctacaacggcacctacatgaacatctccaccgactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactcctccaagaccgaggaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 385 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaaccgcaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacccccgtggagatcgtgtgcacccgccccaacaacaacacccgcaagtccgtgcgcatcggccccggccagaccttctacgccaccggcgacatcatcggcgacatccgccaggcccactgcaacatctccgagaaggagtggaacgacaccctgcagaaggtgggcaaggagctgcagaagcacttccccaacaagaccatcgagtacaagcagtccgccggcggcgacatggagatcaccacccactccttcaactgcggcggcgagttcttctactgcaacacctccaacctgttcaacggcacctacaacggcacctacatgaacatctccaccgactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactcctccaagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 386 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaaccgcaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgcctgcacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacccccgtggagatcgtgtgcacccgccccaacaacaacacccgcaagtccgtgcgcatcggccccggccagaccttctacgccaccggcgacatcatcggcgacatccgccaggcccactgcaacatctccgagaaggagtggaacgacaccctgcagaaggtgggcaaggagctgcagaagcacttccccaacaagaccatcgagtacaagcagtccgccggcggcgacatggagatcaccacccactccttcaactgcggcggcgagttcttctactgcaacacctccaacctgttcaacggcacctacaacggcacctacatgaacatctccaccgactccaactccaccatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcaccaactcctccaagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 387 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaagaaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaaccgcaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacccccgtggagatcgtgtgcacccgccccaacaacaacacccgcaagtccgtgcgcatcggccccggccagtggttctacgccaccggcgacatcatcggcgacatccgccaggcccactgcaacatctccgagaaggagtggaacgacaccctgcagaaggtgggcaaggagctgcagaagcacttccccaacaagaccatcgagtacaagcagtccgccggcggcgacatggagatcaccacccactccttcaactgcggcggcgagttcttctactgcaacacctccaacctgttcaacggcacctacaacggcacctacatgaacatctccaccgactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactcctccaagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 388 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcgcaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaaccgcaccgtggaggagatgaagaactgctccttcaacaccaccaccgagatccgcgacaaggagaagaaggagtacgccctgttctaccgccccgacatcgtgcccctgaacaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacccccgtggagatcgtgtgcacccgccccaacaacaacacccgcaagtccgtgcgcatcggccccggccagtggttctacgccaccggcgacatcatcggcgacatccgccaggcccactgcaacatctccgagaaggagtggaacgacaccctgcagaaggtgggcaaggagctgcagaagcacttccccaacaagaccatcgagtacaagcagtccgccggcggcgacatggagatcaccacccactccttcaactgcggcggcgagttcttctactgcaacacctccaacctgttcaacggcacctacaacggcacctacatgaacatctccaccgactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactcctccaagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 389 - DNA, 2574 bp, Artificial Sequence
  Description of Artificial Sequence: Synthetic polynucleotide
atgcgcgtgatgggcatcctgaagaactacccccagtggtggatctggggcatcctgggcttctggatgctgatgatctgcaacggcaagggcaagctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgtgaacgtgaccggctccaacgtgaacgtgaccaacatcaccaacaccatcaccggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccgtgcgcatcggccccggccagaccttctacgccaccggcggcatcatcggcgacatccgccaggcccactgcaacatctccgagtccaagtggaacgagaccctgcacgaggtgtccaaggagctgcagaagcacttccccaacaagaccatcaagtacgagcgctccgccggcggcgacatggagatcaccacccactccttcaactgcggcggcgagttcttctactgcaacacctccaacctgttcaacggcacctacaacggcacctacaacggcaccaactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacaagaccgaggagaccttccgccccgccggcggcgacatgcgcgacaactggcgctccgagctgtacaagtacaaggtggtggagatccagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaacgtgccctggaacacctcctggtccaacaagtccgagaaggacatctgggacaacatgacctggatgcagtgggagcgcgagatctccaactacaccgagaccatctacaccctgctggaggactcccagcgccagcaggagcgcaacgagaaggacctgctggccctggactcctggaactccctgtggaactggttcaacatcaccaactggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgggcggcatcgaggaggagggcggcgagcaggaccgcgaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcgacaccatcgccatcgccgtggccgagggcaccgaccgcatcctggaggtgatccagcgcttctgccgcgccatccgcaacatccccacccgcatccgccagggcttcgaggcctccctgctgtag

SEQ ID NO: 390 - DNA, 1485 bp, Artificial Sequence
  Description of Artificial Sequence: Synthetic polynucleotide
atgcgcgtgatgggcatcctgaagaactacccccagtggtggatctggggcatcctgggcttctggatgctgatgatctgcaacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgtgaacgtgaccggctccaacgtgaacgtgaccaacatcaccaacaccatcaccggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccgtgcgcatcggccccggccagaccttctacgccaccggcggcatcatcggcgacatccgccaggcccactgcaacatctccgagtccaagtggaacgagaccctgcacgaggtgtccaaggagctgcagaagcacttccccaacaagaccatcaagtacgagcgctccgccggcggcgacatggagatcaccacccactccttcaactgcggcggcgagttcttctactgcaacacctccaacctgttcaacggcacctacaacggcacctacaacggcaccaactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacaagaccgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 391 - DNA, 1968 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgtgaacgtgaccggctccaacgtgaacgtgaccaacatcaccaacaccatcaccggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccgtgcgcatcggccccggccagaccttctacgccaccggcggcatcatcggcgacatccgccaggcccactgcaacatctccgagtccaagtggaacgagaccctgcacgaggtgtccaaggagctgcagaagcacttccccaacaagaccatcaagtacgagcgctccgccggcggcgacatggagatcaccacccactccttcaactgcggcggcgagttcttctactgcaacacctccaacctgttcaacggcacctacaacggcacctacaacggcaccaactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 392 - DNA, 1968 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgtgaacgtgaccggctccaacgtgaacgtgaccaacatcaccaacaccatcaccggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgcctgcacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccgtgcgcatcggccccggccagaccttctacgccaccggcggcatcatcggcgacatccgccaggcccactgcaacatctccgagtccaagtggaacgagaccctgcacgaggtgtccaaggagctgcagaagcacttccccaacaagaccatcaagtacgagcgctccgccggcggcgacatggagatcaccacccactccttcaactgcggcggcgagttcttctactgcaacacctccaacctgttcaacggcacctacaacggcacctacaacggcaccaactccaactccaccatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 393 - DNA, 1968 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaagaaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgtgaacgtgaccggctccaacgtgaacgtgaccaacatcaccaacaccatcaccggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccgtgcgcatcggccccggccagtggttctacgccaccggcggcatcatcggcgacatccgccaggcccactgcaacatctccgagtccaagtggaacgagaccctgcacgaggtgtccaaggagctgcagaagcacttccccaacaagaccatcaagtacgagcgctccgccggcggcgacatggagatcaccacccactccttcaactgcggcggcgagttcttctactgcaacacctccaacctgttcaacggcacctacaacggcacctacaacggcaccaactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 394 - DNA, 1968 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcgcaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgtgaacgtgaccggctccaacgtgaacgtgaccaacatcaccaacaccatcaccggcgagatgaagaactgctccttcaacaccaccaccgagatccgcgacaaggagaagaaggagtacgccctgttctacaagcccgacgtggtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccgtgcgcatcggccccggccagtggttctacgccaccggcggcatcatcggcgacatccgccaggcccactgcaacatctccgagtccaagtggaacgagaccctgcacgaggtgtccaaggagctgcagaagcacttccccaacaagaccatcaagtacgagcgctccgccggcggcgacatggagatcaccacccactccttcaactgcggcggcgagttcttctactgcaacacctccaacctgttcaacggcacctacaacggcacctacaacggcaccaactccaactccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 395 - DNA, 2601 bp, Artificial Sequence
  Description of Artificial Sequence: Synthetic polynucleotide
atgaaggtgatgggcatcctgaagaactacccccagtggtggatctggggcatcctgggcttctggatgctgatgatctgcaagggcaagggcaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaacaaccgcaccgcctacgacacccgctccaacgtgaacgtgacctccatcaacaacaccatcatgggcgagatgaagaactgctccttcaacaccaccaccgagatccgcgacaaggagaagaaggagtacgccctgttctacaagcccgacatcgtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagaagcagtggaacgagaccctgcagaaggtgggcaaggagctgcagaagcacttccccaacaagaccatcaagtacgagcgctccgccggcggcgacatggagatcgccacccactccttcaactgcggcggcgagttcttctactgcaacacctccaagctgttcaacggcacctacaacggcaccgacatcaacatctccaccaactccaactccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactccaacaagaccgaggagaccttccgccccgccggcggcgacatgcgcgacaactggcgctccgagctgtacaagtacaaggtggtggagatccagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaacgtgccctggaacacctcctggtccaacaagtccgagaaggacatctgggacaacatgacctggatgcagtgggagcgcgagatctccaactacaccgagaccatctacatgctgctggaggactcccagcgccagcaggagcgcaacgagaaggacctgctggccctggactcctggaactccctgtggaactggttcaacatcaccaactggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgggcggcatcgaggaggagggcggcgagcaggaccgcaaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcgacaccatcgccatcgccgtggccgagggcaccgaccgcatcctggaggtgatccagcgcttctgccgcgccatccgcaacatccccacccgcatccgccagggcttcgaggcctccctgctgtag

SEQ ID NO: 396 - DNA, 1512 bp, Artificial Sequence
  Description of Artificial Sequence: Synthetic polynucleotide
atgaaggtgatgggcatcctgaagaactacccccagtggtggatctggggcatcctgggcttctggatgctgatgatctgcaagggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaacaaccgcaccgcctacgacacccgctccaacgtgaacgtgacctccatcaacaacaccatcatgggcgagatgaagaactgctccttcaacaccaccaccgagatccgcgacaaggagaagaaggagtacgccctgttctacaagcccgacatcgtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagaagcagtggaacgagaccctgcagaaggtgggcaaggagctgcagaagcacttccccaacaagaccatcaagtacgagcgctccgccggcggcgacatggagatcgccacccactccttcaactgcggcggcgagttcttctactgcaacacctccaagctgttcaacggcacctacaacggcaccgacatcaacatctccaccaactccaactccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactccaacaagaccgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 397 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaacaaccgcaccgcctacgacacccgctccaacgtgaacgtgacctccatcaacaacaccatcatgggcgagatgaagaactgctccttcaacaccaccaccgagatccgcgacaaggagaagaaggagtacgccctgttctacaagcccgacatcgtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagaagcagtggaacgagaccctgcagaaggtgggcaaggagctgcagaagcacttccccaacaagaccatcaagtacgagcgctccgccggcggcgacatggagatcgccacccactccttcaactgcggcggcgagttcttctactgcaacacctccaagctgttcaacggcacctacaacggcaccgacatcaacatctccaccaactccaactccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 398 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaacaaccgcaccgcctacgacacccgctccaacgtgaacgtgacctccatcaacaacaccatcatgggcgagatgaagaactgctccttcaacaccaccaccgagatccgcgacaaggagaagaaggagtacgccctgttctacaagcccgacatcgtgcccctgaacgagacctccaacacctccgagtaccgcctgatcaactgcaacacctccgcctgcacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagaagcagtggaacgagaccctgcagaaggtgggcaaggagctgcagaagcacttccccaacaagaccatcaagtacgagcgctccgccggcggcgacatggagatcgccacccactccttcaactgcggcggcgagttcttctactgcaacacctccaagctgttcaacggcacctacaacggcaccgacatcaacatctccaccaactccaactccaccatcaccctgcagtgccgcatcaagcagatcatcaacatgtggcagggcgtgggccgctgcatgtacgccccccccatcgccggcaacatcacctgcaagtccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 399 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaagaaggtgcacaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaacaaccgcaccgcctacgacacccgctccaacgtgaacgtgacctccatcaacaacaccatcatgggcgagatgaagaactgctccttcaacaccaccaccgagatccgcgacaaggagaagaaggagtacgccctgttctacaagcccgacatcgtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagtggttctacgccaccggcgacatcatcggcgacatccgccaggcccactgcaacatctccgagaagcagtggaacgagaccctgcagaaggtgggcaaggagctgcagaagcacttccccaacaagaccatcaagtacgagcgctccgccggcggcgacatggagatcgccacccactccttcaactgcggcggcgagttcttctactgcaacacctccaagctgttcaacggcacctacaacggcaccgacatcaacatctccaccaactccaactccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 400 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcgcaacgtgtgggccacccacgcctgcgtgcccaccgacccctccccccaggagctgttcctggagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaacaaccgcaccgcctacgacacccgctccaacgtgaacgtgacctccatcaacaacaccatcatgggcgagatgaagaactgctccttcaacaccaccaccgagatccgcgacaaggagaagaaggagtacgccctgttctacaagcccgacatcgtgcccctgaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagtggttctacgccaccggcgacatcatcggcgacatccgccaggcccactgcaacatctccgagaagcagtggaacgagaccctgcagaaggtgggcaaggagctgcagaagcacttccccaacaagaccatcaagtacgagcgctccgccggcggcgacatggagatcgccacccactccttcaactgcggcggcgagttcttctactgcaacacctccaagctgttcaacggcacctacaacggcaccgacatcaacatctccaccaactccaactccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaactccaacaagaccgaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 401 - DNA, 2595 bp, Artificial Sequence
  Description of Artificial Sequence: Synthetic polynucleotide
atgcgcgtgaccggcatcctgcgcaactacccccagtggtggatctggggcatcctgggcttctggatgctgatgaactgcaacggcgagggcaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccatcgtgaagaactccaccaccgaggagatgtccaccgccctggtgaagaactccaccaccgaggccatgaagaactgctccttcaacaccaccaccgagatccgcgacaaggagaagaaggagtacgccctgttctaccgccccgacatcgtgcccctgaacaacgagaccggcaacatctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccaaggaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacccccgcaaggcccactgcaacatctccgagaaggactggaacaagaccctgcaggaggtgggcaaggagctgcagaagcacttccccaacaagaccatccgctacaaccagtccgccggcggcgacatggagatcaccacccactccttcaactgcggcggcgagttcttctactgcaacacctccaagctgttcaactccacctacaacgacacctacatctccaccaactcctccgccaacaactcctccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggccccgactccaacgagaccgagaccttccgccccgccggcggcgacatgcgcgacaactggcgctccgagctgtacaagtacaaggtggtggaggtgcagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatctggggctgctccggcaagctgatctgcaccaccaacgtgccctggaacacctcctggtccaacaagtccgagaccgacatctggggcaacatgacctggatgcagtgggagcgcgagatctccaactacaccgagaccatctacaagctgctggaggactcccagaaccagcaggagcgcaacgagcagaacctgctggccctggactcctggaactccctgtggaactggttctccatcaccaagtggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgcgcggcatcgaggaggagggcggcgagcaggaccgcgacaagtccatccgcctggtgaacggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgctggacaccatcgccatcgccgtggccgagggcaccgaccgcatcatcgaggccatccagggcttctgccgcgccatccgcaacatcccccgccgcatccgccagggcttcgaggcctccctgctgtag

SEQ ID NO: 402 - DNA, 1506 bp, Artificial Sequence
  Description of Artificial Sequence: Synthetic polynucleotide
atgcgcgtgaccggcatcctgcgcaactacccccagtggtggatctggggcatcctgggcttctggatgctgatgaactgcaacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccatcgtgaagaactccaccaccgaggagatgtccaccgccctggtgaagaactccaccaccgaggccatgaagaactgctccttcaacaccaccaccgagatccgcgacaaggagaagaaggagtacgccctgttctaccgccccgacatcgtgcccctgaacaacgagaccggcaacatctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccaaggaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacccccgcaaggcccactgcaacatctccgagaaggactggaacaagaccctgcaggaggtgggcaaggagctgcagaagcacttccccaacaagaccatccgctacaaccagtccgccggcggcgacatggagatcaccacccactccttcaactgcggcggcgagttcttctactgcaacacctccaagctgttcaactccacctacaacgacacctacatctccaccaactcctccgccaacaactcctccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggccccgactccaacgagaccgagaccttccgccccgccggcggcgacatgcgcgacaactggcgctccgagctgtacaagtacaaggtggtggaggtgcagcccctgggcatcgcccccaccggcgccaaggagcgcgtggtggagcgcgagaaggagtag

SEQ ID NO: 403 - DNA, 1989 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccatcgtgaagaactccaccaccgaggagatgtccaccgccctggtgaagaactccaccaccgaggccatgaagaactgctccttcaacaccaccaccgagatccgcgacaaggagaagaaggagtacgccctgttctaccgccccgacatcgtgcccctgaacaacgagaccggcaacatctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccaaggaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacccccgcaaggcccactgcaacatctccgagaaggactggaacaagaccctgcaggaggtgggcaaggagctgcagaagcacttccccaacaagaccatccgctacaaccagtccgccggcggcgacatggagatcaccacccactccttcaactgcggcggcgagttcttctactgcaacacctccaagctgttcaactccacctacaacgacacctacatctccaccaactcctccgccaacaactcctccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggccccgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 404 - DNA, 1989 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccatcgtgaagaactccaccaccgaggagatgtccaccgccctggtgaagaactccaccaccgaggccatgaagaactgctccttcaacaccaccaccgagatccgcgacaaggagaagaaggagtacgccctgttctaccgccccgacatcgtgcccctgaacaacgagaccggcaacatctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccaaggaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacccccgcaaggcccactgcaacatctccgagaaggactggaacaagaccctgcaggaggtgggcaaggagctgcagaagcacttccccaacaagaccatccgctacaaccagtccgccggcggcgacatggagatcaccacccactccttcaactgcggcggcgagttcttctactgcaacacctccaagctgttcaactccacctacaacgacacctacatctccaccaactcctccgccaacaactcctccaccatcaccctgcagtgccgcatcaagcagatcatcaacatgtggcagggcgtgggccgctgcatgtacgccccccccatcgccggcaacatcacctgcaagtccaacatcaccggcctgctgctgacccgcgacggcggccccgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 405 - DNA, 1989 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaagaaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccatcgtgaagaactccaccaccgaggagatgtccaccgccctggtgaagaactccaccaccgaggccatgaagaactgctccttcaacaccaccaccgagatccgcgacaaggagaagaaggagtacgccctgttctaccgccccgacatcgtgcccctgaacaacgagaccggcaacatctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccaaggaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgacccccgcaaggcccactgcaacatctccgagaaggactggaacaagaccctgcaggaggtgggcaaggagctgcagaagcacttccccaacaagaccatccgctacaaccagtccgccggcggcgacatggagatcaccacccactccttcaactgcggcggcgagttcttctactgcaacacctccaagctgttcaactccacctacaacgacacctacatctccaccaactcctccgccaacaactcctccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggccccgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 406 - DNA, 1989 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcgcaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccatcgtgaagaactccaccaccgaggagatgtccaccgccctggtgaagaactccaccaccgaggccatgaagaactgctccttcaacaccaccaccgagatccgcgacaaggagaagaaggagtacgccctgttctaccgccccgacatcgtgcccctgaacaacgagaccggcaacatctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccaaggaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgacccccgcaaggcccactgcaacatctccgagaaggactggaacaagaccctgcaggaggtgggcaaggagctgcagaagcacttccccaacaagaccatccgctacaaccagtccgccggcggcgacatggagatcaccacccactccttcaactgcggcggcgagttcttctactgcaacacctccaagctgttcaactccacctacaacgacacctacatctccaccaactcctccgccaacaactcctccaccatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggccccgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 407 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 408 - protein, 852 aa, Artificial Sequence
  Description of Artificial Sequence: Synthetic polypeptide
MRVTGILKNYPQWWIWGILGFWMLMICNGEENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDKDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 409 - protein, 854 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQRFCRAIRNIPTRIRQGFEASLL

SEQ ID NO: 410 - protein, 871 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVEIQPLGIAPTGAKRRVVGREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 411 - protein, 508 aa, Artificial Sequence
  Description of Artificial Sequence: Synthetic polypeptide
MRVTGILKNYPRWWIWGILGFWMLMNCNGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVEIQPLGIAPTGAKERVVGREKE

SEQ ID NO: 412 - protein, 491 aa, Artificial Sequence
  Description of Artificial Sequence: Synthetic polypeptide
TRVMGILKNYPQWWIWGILGFWMLMICNGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVEIQPLGIAPTGAKERVVEREKE

SEQ ID NO: 413 - protein, 489 aa, Artificial Sequence
  Description of Artificial Sequence: Synthetic polypeptide
MRVTGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVEVQPLGIAPTGAKERVVEREKE

SEQ ID NO: 414 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 415 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRCMYAPPIAGNITCRSNITGLLLTRDGGINNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 416 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKKVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQWFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 417 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYKKEVRNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQWFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 418 - protein, 669 aa, Artificial Sequence
  Description of Artificial Sequence: Synthetic polypeptide
MPMGSLQPLATLYLLGMLVASVLAAENLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 419 - protein, 669 aa, Artificial Sequence
  Description of Artificial Sequence: Synthetic polypeptide
MPMGSLQPLATLYLLGMLVASVLAAENLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSACTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRCMYAPPIAGNITCRSNITGLLLTRDGGIHNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 420 - protein, 669 aa, Artificial Sequence
  Description of Artificial Sequence: Synthetic polypeptide
MPMGSLQPLATLYLLGMLVASVLAAENLWVTVYYGVPVWKEAKTTLFCASDAKAYVKKVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQWFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 421 - protein, 669 aa, Artificial Sequence
  Description of Artificial Sequence: Synthetic polypeptide
MPMGSLQPLATLYLLGMLVASVLAAENLWVTVYYGVPVWKEAKTTLFCASDAKAYVKEVRNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQWFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 422 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 423 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRCMYAPPIAGNITCKSNVTGLLLTRDGGTNSSQTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 424 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 425 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVRNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 426 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 427 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVRNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 428 - DNA, 2559 bp, Artificial Sequence
  Description of Artificial Sequence: Synthetic polynucleotide
atgcgcgtgaccggcatcctgaagaactacccccagtggtggatctggggcatcctgggcttctggatgctgatgatctgcaacggcgaggagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatgtgctccaacgccatcgtgaagaactccaccaccgaggagatgaagaactgctccttcaacaccaccaccgagatccgcgacaaggagaagaaggagtacgccctgttctaccgccccgacatcgtgcccctgaacaacaagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtgcagatcgtgtgcacccgccccaacaacaacacccgcaagtccgtgcgcatcggccccggccagaccttctacgccaccggcgacatcatcggcgacccccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccaccgactccacctccaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatcaacaacgactccaacgagaccgagaccttccgccccgccggcggcgacatgcgcgacaactggcgctccgagctgtacaagtacaaggtggtggaggtgcagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaacgtgccctggaacacctcctggtccaacaagtccgagaccgacatctgggacaacatgacctggatgcagtgggagcgcgagatctccaactacaccgagaccatctacaagctgctggaggactcccagaaccagcaggagcgcaacgagcaggacctgctggccctggactcctggaactccctgtggaactggttctccatcaccaagtggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgcgcggcatcgaggaggagggcggcgagcaggacaaggaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcgacaccctggccatcgccgtggccgagggcaccgaccgcatcatcgaggccatccagggcttctgccgcgccatccgcaacatccccacccgcatccgccagggcttcgaggcctccctgctgtag

SEQ ID NO: 429 - DNA, 2565 bp, Artificial Sequence
  Description of Artificial Sequence: Synthetic polynucleotide
acccgcgtgatgggcatcctgaagaactacccccagtggtggatctggggcatcctgggcttctggatgctgatgatctgcaacggcaagggcaagctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggacaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaccgccaccgtggacaactccaccgtggaggagatgaagaactgctccttcaacaccaccaccgagatccgcgacaaggagaagaaggagtacgccctgttctaccgccccgacatcgtgcccctgaacgagaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgagatccgccaggcccactgcaacatctccgaggaggagtggaacgagaccctgcagaaggtgggcaaggagctgcagaagcacttccccaacaagaccatcaagtacgagcagtccgccggcggcgacatggagatcaccacccactccttcaactgcggcggcgagttcttctactgcaacaccgccaacctgttcaacggcacctacaacggcaccgacatctccaccaactcctccaccaagtccaactccaccatcaccctgcagtgccgcatcaagcagatcatcaacatgtggcagggcgtgggccgcgccatgtacgccccccccatcgccggcaacatcacctgcaagtccaacgtgaccggcctgctgctgacccgcgacggcggcaccaactcctcccagaccgaggaggagaccttccgccccgccggcggcgacatgcgcgacaactggcgctccgagctgtacaagtacaaggtggtggagatccagcccctgggcatcgcccccaccggcgccaagcgccgcgtggtggagcgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccaacgtgccctggaacacctcctggtccaacaagtccgagatggacatctgggacaacatgacctggatgcagtgggagcgcgagatctccaactacaccgagaccatctacaagctgctggaggactcccagaaccagcaggagcgcaacgagcaggacctgctggccctggactcctggaactccctgtggaactggttcaacatcaccaagtggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgcgcggcatcgaggaggagggcggcgagcaggaccgcgaccgctccatccgcctggtgtccggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcgacaccctggccatcgccgtggccgagggcaccgaccgcatcatcgagctgatccagcgcttctgccgcgccatccgcaacatccccacccgcatccgccagggcttcgaggcctccctgctgtag

SEQ ID NO: 430 - DNA, 2616 bp, Artificial Sequence
  Description of Artificial Sequence: Synthetic polynucleotide
atgcgcgtgaccggcatcctgaagaactacccccgctggtggatctggggcatcctgggcttctggatgctgatgaactgcaacggcgagggcaagctgtgggtgaccgtgtactacggcgtgcccgtgtggaaggaggccaagaccaccctgttctgcgcctccgacgccaaggcctacgtgaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtgaacaacaccaccgactacgactcccgctccaacgccaacgtgaccaacatcaccaacaccatcaaggaggaggtgaagaactgctccttcaagaccaccaccgagatccgcgacaaggagaagaaggagcacgccctgttctaccgccccgacatcgtgcccctgaactccgagaccggcaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaaggtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccatgcgcatcggccccggccagaccttctacgccaccggcgacatcatcggcgacatccgccaggcccactgcaacatctccgagtccaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactcctccgccaactccacctccaagaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatccacaacgactccaacgagaccgagaccttccgccccgccggcggcgacatgcgcgacaactggcgctccgagctgtacaagtacaaggtggtggagatccagcccctgggcatcgcccccaccggcgccaagcgccgcgtggtgggccgcgagaagcgcgccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatctggggctgctccggcaagctgatctgcaccaccaacgtgccctggaacacctcctggtccaacaagtccgagaccgacatctgggagaacatgacctggatgcagtgggagcgcgagatctccaactacaccgagaccatctacaagctgctggaggactcccagaaccagcaggagcgcaacgagcaggacctgctggccctggactcctggaactccctgtggaactggttctccatcaccaagtggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgacccccaacccccgcgagcccgaccgcctgcgcggcatcgaggaggagggcggcgagcaggaccgcgacaagtccatccgcctggtgaacggcttcctgcccatcgtgtgggacgacctgcgctccctgtgcctgttctcctaccaccgcctgcgcgacttcctgctgctggccgcccgcgtggtggagctgctgggccgctcctccctgcgcggcctgcagcgcggctgggaggtgctgaagtacctgggctccctggtgcagtactggggcctggagctgaagaagtccgccatctccctgttcgacaccctggccatcgccgtggccgagggcaccgaccgcatcatcgaggccatccagggcttctgccgcgccatccgcaacatccccacccgcatccgccagggcttcgaggcctccctgctgtag

SEQ ID NO: 431 - DNA, 1527 bp, Artificial Sequence
  Description of Artificial Sequence: Synthetic polynucleotide
atgcgcgtgaccggcatcctgaagaactacccccgctggtggatctggggcatcctgggcttctggatgctgatgaactgcaacggcgtgcccgtgtggaaggaggccaagaccaccctgttctgcgcctccgacgccaaggcctacgtgaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtgaacaacaccaccgactacgactcccgctccaacgccaacgtgaccaacatcaccaacaccatcaaggaggaggtgaagaactgctccttcaagaccaccaccgagatccgcgacaaggagaagaaggagcacgccctgttctaccgccccgacatcgtgcccctgaactccgagaccggcaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaaggtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccatgcgcatcggccccggccagaccttctacgccaccggcgacatcatcggcgacatccgccaggcccactgcaacatctccgagtccaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactcctccgccaactccacctccaagaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatccacaacgactccaacgagaccgagaccttccgccccgccggcggcgacatgcgcgacaactggcgctccgagctgtacaagtacaaggtggtggagatccagcccctgggcatcgcccccaccggcgccaaggagcgcgtggtgggccgcgagaaggagtag

SEQ ID NO: 432 - DNA, 1476 bp, Artificial Sequence
  Description of Artificial Sequence: Synthetic polynucleotide
acccgcgtgatgggcatcctgaagaactacccccagtggtggatctggggcatcctgggcttctggatgctgatgatctgcaacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggacaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaccgccaccgtggacaactccaccgtggaggagatgaagaactgctccttcaacaccaccaccgagatccgcgacaaggagaagaaggagtacgccctgttctaccgccccgacatcgtgcccctgaacgagaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgagatccgccaggcccactgcaacatctccgaggaggagtggaacgagaccctgcagaaggtgggcaaggagctgcagaagcacttccccaacaagaccatcaagtacgagcagtccgccggcggcgacatggagatcaccacccactccttcaactgcggcggcgagttcttctactgcaacaccgccaacctgttcaacggcacctacaacggcaccgacatctccaccaactcctccaccaagtccaactccaccatcaccctgcagtgccgcatcaagcagatcatcaacatgtggcagggcgtgggccgcgccatgtacgccccccccatcgccggcaacatcacctgcaagtccaacgtgaccggcctgctgctgacccgcgacggcggcaccaactcctcccagaccgaggaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 433 - DNA, 1470 bp, Artificial Sequence
  Description of Artificial Sequence: Synthetic polynucleotide
atgcgcgtgaccggcatcctgaagaactacccccagtggtggatctggggcatcctgggcttctggatgctgatgatctgcaacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatgtgctccaacgccatcgtgaagaactccaccaccgaggagatgaagaactgctccttcaacaccaccaccgagatccgcgacaaggagaagaaggagtacgccctgttctaccgccccgacatcgtgcccctgaacaacaagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtgcagatcgtgtgcacccgccccaacaacaacacccgcaagtccgtgcgcatcggccccggccagaccttctacgccaccggcgacatcatcggcgacccccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccaccgactccacctccaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatcaacaacgactccaacgagaccgagaccttccgccccgccggcggcgacatgcgcgacaactggcgctccgagctgtacaagtacaaggtggtggaggtgcagcccctgggcatcgcccccaccggcgccaaggagcgcgtggtggagcgcgagaaggagtag

SEQ ID NO: 434 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatgtgctccaacgccatcgtgaagaactccaccaccgaggagatgaagaactgctccttcaacaccaccaccgagatccgcgacaaggagaagaaggagtacgccctgttctaccgccccgacatcgtgcccctgaacaacaagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtgcagatcgtgtgcacccgccccaacaacaacacccgcaagtccgtgcgcatcggccccggccagaccttctacgccaccggcgacatcatcggcgacccccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccaccgactccacctccaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatcaacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 435 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatgtgctccaacgccatcgtgaagaactccaccaccgaggagatgaagaactgctccttcaacaccaccaccgagatccgcgacaaggagaagaaggagtacgccctgttctaccgccccgacatcgtgcccctgaacaacaagacctccaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtgcagatcgtgtgcacccgccccaacaacaacacccgcaagtccgtgcgcatcggccccggccagaccttctacgccaccggcgacatcatcggcgacccccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccaccgactccacctccaacatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcatcaacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 436 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaagaaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatgtgctccaacgccatcgtgaagaactccaccaccgaggagatgaagaactgctccttcaacaccaccaccgagatccgcgacaaggagaagaaggagtacgccctgttctaccgccccgacatcgtgcccctgaacaacaagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtgcagatcgtgtgcacccgccccaacaacaacacccgcaagtccgtgcgcatcggccccggccagtggttctacgccaccggcgacatcatcggcgacccccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccaccgactccacctccaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatcaacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 437 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacaagaaggaggtgcgcaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgatgtgctccaacgccatcgtgaagaactccaccaccgaggagatgaagaactgctccttcaacaccaccaccgagatccgcgacaaggagaagaaggagtacgccctgttctaccgccccgacatcgtgcccctgaacaacaagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtgcagatcgtgtgcacccgccccaacaacaacacccgcaagtccgtgcgcatcggccccggccagtggttctacgccaccggcgacatcatcggcgacccccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccaccgactccacctccaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatcaacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 438 - DNA, 2010 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgtgaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtgaacaacaccaccgactacgactcccgctccaacgccaacgtgaccaacatcaccaacaccatcaaggaggaggtgaagaactgctccttcaagaccaccaccgagatccgcgacaaggagaagaaggagcacgccctgttctaccgccccgacatcgtgcccctgaactccgagaccggcaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaaggtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccatgcgcatcggccccggccagaccttctacgccaccggcgacatcatcggcgacatccgccaggcccactgcaacatctccgagtccaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactcctccgccaactccacctccaagaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatccacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 439 - DNA, 2010 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgtgaaggaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtgaacaacaccaccgactacgactcccgctccaacgccaacgtgaccaacatcaccaacaccatcaaggaggaggtgaagaactgctccttcaagaccaccaccgagatccgcgacaaggagaagaaggagcacgccctgttctaccgccccgacatcgtgcccctgaactccgagaccggcaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaaggtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccatgcgcatcggccccggccagaccttctacgccaccggcgacatcatcggcgacatccgccaggcccactgcaacatctccgagtccaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactcctccgccaactccacctccaagaacatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcatccacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 440 - DNA, 2010 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgtgaagaaggtgcacaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtgaacaacaccaccgactacgactcccgctccaacgccaacgtgaccaacatcaccaacaccatcaaggaggaggtgaagaactgctccttcaagaccaccaccgagatccgcgacaaggagaagaaggagcacgccctgttctaccgccccgacatcgtgcccctgaactccgagaccggcaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaaggtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccatgcgcatcggccccggccagtggttctacgccaccggcgacatcatcggcgacatccgccaggcccactgcaacatctccgagtccaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactcctccgccaactccacctccaagaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatccacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 441 - DNA, 2010 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgtgaaggaggtgcgcaacgtgtgggccacccacgcctgcgtgcccaccgacccctccccccaggagctgttcctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtgaacaacaccaccgactacgactcccgctccaacgccaacgtgaccaacatcaccaacaccatcaaggaggaggtgaagaactgctccttcaagaccaccaccgagatccgcgacaaggagaagaaggagcacgccctgttctaccgccccgacatcgtgcccctgaactccgagaccggcaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaaggtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacacctccgtggagatcgtgtgcacccgccccggcaacaacacccgcaagtccatgcgcatcggccccggccagtggttctacgccaccggcgacatcatcggcgacatccgccaggcccactgcaacatctccgagtccaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactcctccgccaactccacctccaagaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatccacaacgactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 442 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggacaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaccgccaccgtggacaactccaccgtggaggagatgaagaactgctccttcaacaccaccaccgagatccgcgacaaggagaagaaggagtacgccctgttctaccgccccgacatcgtgcccctgaacgagaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgagatccgccaggcccactgcaacatctccgaggaggagtggaacgagaccctgcagaaggtgggcaaggagctgcagaagcacttccccaacaagaccatcaagtacgagcagtccgccggcggcgacatggagatcaccacccactccttcaactgcggcggcgagttcttctactgcaacaccgccaacctgttcaacggcacctacaacggcaccgacatctccaccaactcctccaccaagtccaactccaccatcaccctgcagtgccgcatcaagcagatcatcaacatgtggcagggcgtgggccgcgccatgtacgccccccccatcgccggcaacatcacctgcaagtccaacgtgaccggcctgctgctgacccgcgacggcggcaccaactcctcccagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 443 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctgttcctggacaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaccgccaccgtggacaactccaccgtggaggagatgaagaactgctccttcaacaccaccaccgagatccgcgacaaggagaagaaggagtacgccctgttctaccgccccgacatcgtgcccctgaacgagaacgagacctccaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgagatccgccaggcccactgcaacatctccgaggaggagtggaacgagaccctgcagaaggtgggcaaggagctgcagaagcacttccccaacaagaccatcaagtacgagcagtccgccggcggcgacatggagatcaccacccactccttcaactgcggcggcgagttcttctactgcaacaccgccaacctgttcaacggcacctacaacggcaccgacatctccaccaactcctccaccaagtccaactccaccatcaccctgcagtgccgcatcaagcagatcatcaacatgtggcagggcgtgggccgctgcatgtacgccccccccatcgccggcaacatcacctgcaagtccaacgtgaccggcctgctgctgacccgcgacggcggcaccaactcctcccagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 444 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaagaaggtgcacaacgtgtgggccacccacgcctgcgtgcccaccgacccctccccccaggagctgttcctggacaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaccgccaccgtggacaactccaccgtggaggagatgaagaactgctccttcaacaccaccaccgagatccgcgacaaggagaagaaggagtacgccctgttctaccgccccgacatcgtgcccctgaacgagaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgagatccgccaggcccactgcaacatctccgaggaggagtggaacgagaccctgcagaaggtgggcaaggagctgcagaagcacttccccaacaagaccatcaagtacgagcagtccgccggcggcgacatggagatcaccacccactccttcaactgcggcggcgagttcttctactgcaacaccgccaacctgttcaacggcacctacaacggcaccgacatctccaccaactcctccaccaagtccaactccaccatcaccctgcagtgccgcatcaagcagatcatcaacatgtggcagggcgtgggccgcgccatgtacgccccccccatcgccggcaacatcacctgcaagtccaacgtgaccggcctgctgctgacccgcgacggcggcaccaactcctcccagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 445 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcgcaacgtgtgggccacccacgcctgcgtgcccaccgacccctccccccaggagctgttcctggacaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaccgccaccgtggacaactccaccgtggaggagatgaagaactgctccttcaacaccaccaccgagatccgcgacaaggagaagaaggagtacgccctgttctaccgccccgacatcgtgcccctgaacgagaacgagacctccaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgagatccgccaggcccactgcaacatctccgaggaggagtggaacgagaccctgcagaaggtgggcaaggagctgcagaagcacttccccaacaagaccatcaagtacgagcagtccgccggcggcgacatggagatcaccacccactccttcaactgcggcggcgagttcttctactgcaacaccgccaacctgttcaacggcacctacaacggcaccgacatctccaccaactcctccaccaagtccaactccaccatcaccctgcagtgccgcatcaagcagatcatcaacatgtggcagggcgtgggccgcgccatgtacgccccccccatcgccggcaacatcacctgcaagtccaacgtgaccggcctgctgctgacccgcgacggcggcaccaactcctcccagaccgaggaggagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 446 - DNA, 1947 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaagaaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 447 - DNA, 1947 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgcccgcgcctacgagaaggaggtgcgcaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagtggttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 448 - protein, 24 aa, Homo sapiens
MPMGSLQPLATLYLLGMLVASVLA

SEQ ID NO: 449 - protein, 648 aa, Artificial Sequence; identical to SEQ ID NO: 426
  Description of Artificial Sequence: Synthetic polypeptide

SEQ ID NO: 450 - protein, 850 aa, Human immunodeficiency virus 1
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 451 - protein, 845 aa, Artificial Sequence
  Description of Artificial Sequence: Synthetic polypeptide
MPMGSLQPLATLYLLGMLVASCLGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 452 - protein, 834 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 453 - protein, 834 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 454 - protein, 482 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKERVVEREKE

SEQ ID NO: 455 - DNA, 1446 bp, Artificial Sequence
  Description of Artificial Sequence: Synthetic polynucleotide
atgcccatgggctccctgcagcccctggccaccctgtacctgctgggcatgctggtggcctcctgcctgggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccatctccgagaccaacaacacctccgagtaccgcctgatcaactgcgacacctccgccgtgacccaggcctgccccaaggtgaccttcgagcccatccccatccactactgcgcccccgccggctacgccatcctgaagtgcaacaacgagaccttcaacggcaccggcccctgcaccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaagacccccgtggagatcaactgcacccgccccaacaacaacacccgcaagtccatccgcatcggccccggccagaccttctacgccaccggcgacatcatcggcgacatcaagcaggcccactgcaacatctccgaggccaagtggaacgacaccctgcagaacgtgtccatcgagctgcagaagcacttccccaacaagaccatcaagtacaaccagtccgccggcggcgacatggagatcaccacccactccttcaactgcggcggcgagttcttctactgcgacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctcctccatcaccggcctgctgctgacccgcgacggcggcaccaactccaacgagaccgagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggag

SEQ ID NO: 456 - protein, 850 aa, Human immunodeficiency virus 1
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCNTSAVTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 457 - protein, 845 aa, Artificial Sequence
  Description of Artificial Sequence: Synthetic polypeptide
MPMGSLQPLATLYLLGMLVASCLGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCNTSAVTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 458 - protein, 834 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCNTSAVTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 459 - protein, 834 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCNTSAVTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 460 - protein, 482 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCNTSAVTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKERVVEREKE

SEQ ID NO: 461 - DNA, 1446 bp, Artificial Sequence
  Description of Artificial Sequence: Synthetic polynucleotide
atgcccatgggctccctgcagcccctggccaccctgtacctgctgggcatgctggtggcctcctgcctgggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccatctccgagaccaacaacacctccgagtaccgcctgatcaactgcaacacctccgccgtgacccaggcctgccccaaggtgaccttcgagcccatccccatccactactgcgcccccgccggctacgccatcctgaagtgcaacaacgagaccttcaacggcaccggcccctgcaccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcaactgcacccgccccaacaacaacacccgcaagtccatccgcatcggccccggccagaccttctacgccaccggcgacatcatcggcgacatcaagcaggcccactgcaacatctccgaggccaagtggaacgacaccctgcagaacgtgtccatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctcctccatcaccggcctgctgctgacccgcgacggcggcaccaactccaacgagaccgagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggag

SEQ ID NO: 462 - protein, 867 aa, Human immunodeficiency virus 1
TRVMGIPKNYPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVERGKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIELIQGFCRAIRNIPRRIRQGFEASLL

SEQ ID NO: 463 - protein, 862 aa, Artificial Sequence
  Description of Artificial Sequence: Synthetic polypeptide
MPMGSLQPLATLYLLGMLVASCLGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVERGKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIELIQGFCRAIRNIPRRIRQGFEASLL

SEQ ID NO: 464 - protein, 851 aa, Artificial Sequence
  Description of Artificial Sequence: Synthetic polypeptide
MPMGSLQPLATLYLLGMLVASCLGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVERGKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIELIQGFCRAIRNIPRRIRQGFEASLL

SEQ ID NO: 465 - protein, 851 aa, Artificial Sequence
  Description of Artificial Sequence: Synthetic polypeptide
MPMGSLQPLATLYLLGMLVASCLGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKERVVERGKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIELIQGFCRAIRNIPRRIRQGFEASLL

SEQ ID NO: 466 - protein, 499 aa, Artificial Sequence
  Description of Artificial Sequence: Synthetic polypeptide
MPMGSLQPLATLYLLGMLVASCLGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKERVVERGKE

SEQ ID NO: 467 - DNA, 1497 bp, Artificial Sequence
  Description of Artificial Sequence: Synthetic polynucleotide
atgcccatgggctccctgcagcccctggccaccctgtacctgctgggcatgctggtggcctcctgcctgggcgtgcccgtgtggaaggaggccaagaccaccctgttctgcgcctccgacgccaaggcctacgtgaaggaggtgcacaacgtgtgggccacccacgcctgcgtgcccaccgacccctccccccaggagctggtgctggacaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccatcgtgaagaactccaccaccgaggagatctcccacgccctggcccgcaactccaccaccgaggagatgaagaactgctccttcaacaccaccaccgagatccgcgacaaggagaagaaggagtacgccctgttctaccgccccgacatcgtgcccctgaacaacaagacctccaacatctccgagtaccgcctgatcaactgcaacacctccaccgtgacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaagggcatcgtgatccgctccgagaacctgaccaacaacgccaagatcatcatcgtgcagctgaacgccaacgcctccgtggagatcgtgtgcacccgccccaacaacaacacccgcaagtccgtgcgcatcggccccggccagaccttctacgccaccggcgacatcatcggcaacatccgccaggcccactgcaacatctccgagaagaagtggaacgagaccctgcagaaggtgggcatcgagctgcagaagcacttccccaacaagaccatcaagtacaaccagtccgccggcggcgacatggagatcaccacccactccttcaactgcggcggcgagttcttctactgcaacaccgccaagctgttcaactccacctacaacggcacctacatctccaccaactccatcaactccaccctgaacatcaccctgcagtgccgcatcaagcagatcatcaacatgtggcagggcgtgggccgcgccatgtacgccccccccatcgccggcaacatcacctgccgctccaacatcaccggcctgctgctgacccgcgacggcggcatccacaacgactccaacgtgaccgagaccttccgccccgccggcggcgacatgcgcgacaactggcgctccgagctgtacaagtacaaggtggtggagatccagcccctgggcatcgcccccaccggcgccaaggagcgcgtggtggagcgcggcaaggag

SEQ ID NO: 468 - protein, 860 aa, Human immunodeficiency virus 1
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICQAFNSSSHTNSSIAMQEMKNCSFNVTTELRDKKKKEYSFFYKTDIEQINKNGRQYRLINCNTSAITQDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 469 - protein, 855 aa, Artificial Sequence
  Description of Artificial Sequence: Synthetic polypeptide
MPMGSLQPLATLYLLGMLVASCLGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICQAFNSSSHTNSSIAMQEMKNCSFNVTTELRDKKKKEYSFFYKTDIEQINKNGRQYRLINCNTSAITQDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 470 - protein, 844 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICQAFNSSSHTNSSIAMQEMKNCSFNVTTELRDKKKKEYSFFYKTDIEQINKNGRQYRLINCNTSAITQDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 471 - protein, 844 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICQAFNSSSHTNSSIAMQEMKNCSFNVTTELRDKKKKEYSFFYKTDIEQINKNGRQYRLINCNTSAITQDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLAIERYLKDQQLLGMWGCSGKLICTTNVPWNASWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSGRLVHGFLPIVWDDLRSLCLFSYHQLRDLLLLAARVVELLGRSSLRGLQRGWEVLKYLGSLVQYWGLELKKSAISLFDTLAIAVAEGTDRIIELIQRICRAIRNIPTRIRQGFEASLL

SEQ ID NO: 472 - protein, 492 aa, Artificial Sequence
  Description of Artificial Sequence: Synthetic polypeptide
MPMGSLQPLATLYLLGMLVASCLGVPVWKEAKTTLFCASDARAYEKEVHNVWATHACVPTDPSPQELVLGNVTENFNMWKNDMVDQMHEDIISLWDQSLKPCVKLTPLCVTLICQAFNSSSHTNSSIAMQEMKNCSFNVTTELRDKKKKEYSFFYKTDIEQINKNGRQYRLINCNTSAITQDTSAVTQACPKVTFEPIPIHYCAPAGYAILKCNNETFNGTGPCTNVSTVQCTHGIRPVVSTQLLLNGSLAEKEIVIRSENLTNNAKIIIVHLKTPVEINCTRPNNNTRKSIRIGPGQTFYATGDIIGDIKQAHCNISEAKWNDTLQNVSIELQKHFPNKTIKYNQSAGGDMEITTHSFNCGGEFFYCDTSNLFNGTYNGTYISTNSSANSTSTITLQCRIKQIINMWQGVGRAMYAPPIAGNITCRSSITGLLLTRDGGTNSNETETFRPAGGDMRDNWRSELYKYKVVEIQPLGIAPTGAKERVVEREKE

SEQ ID NO: 473 - DNA, 1476 bp, Artificial Sequence
  Description of Artificial Sequence: Synthetic polynucleotide
atgcccatgggctccctgcagcccctggccaccctgtacctgctgggcatgctggtggcctcctgcctgggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgccaggccttcaactcctcctcccacaccaactcctccatcgccatgcaggagatgaagaactgctccttcaacgtgaccaccgagctgcgcgacaagaagaagaaggagtactccttcttctacaagaccgacatcgagcagatcaacaagaacggccgccagtaccgcctgatcaactgcaacacctccgccatcacccaggacacctccgccgtgacccaggcctgccccaaggtgaccttcgagcccatccccatccactactgcgcccccgccggctacgccatcctgaagtgcaacaacgagaccttcaacggcaccggcccctgcaccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaagacccccgtggagatcaactgcacccgccccaacaacaacacccgcaagtccatccgcatcggccccggccagaccttctacgccaccggcgacatcatcggcgacatcaagcaggcccactgcaacatctccgaggccaagtggaacgacaccctgcagaacgtgtccatcgagctgcagaagcacttccccaacaagaccatcaagtacaaccagtccgccggcggcgacatggagatcaccacccactccttcaactgcggcggcgagttcttctactgcgacacctccaacctgttcaacggcacctacaacggcacctacatctccaccaactcctccgccaactccacctccaccatcaccctgcagtgccgcatcaagcagatcatcaacatgtggcagggcgtgggccgcgccatgtacgccccccccatcgccggcaacatcacctgccgctcctccatcaccggcctgctgctgacccgcgacggcggcaccaactccaacgagaccgagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggag

SEQ ID NO: 474 - protein, 488 aa, Artificial Sequence
  Description of Artificial Sequence: Synthetic polypeptide
MPMGSLQPLATLYLLGMLVASVLAVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSAITQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWHNSTWTNSTTGSNGTESNDTITLQCEIKQFINMWQRVGRAMYAPPIPGVIRCESDITGLLLTRDGPNSTQNETFRPGGGDMRDNWRSELYKYKVVQIEPLGVAPTHAKERVVEREKE

SEQ ID NO: 475 - protein, 654 aa, Artificial Sequence
  Description of Artificial Sequence: Synthetic polypeptide
MPMGSLQPLATLYLLGMLVASVLAAENLWVTVYYGVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSAITQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWHNSTWTNSTTGSNGTESNDTITLQCEIKQFINMWQRVGRAMYAPPIPGVIRCESDITGLLLTRDGPNSTQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 476 - protein, 664 aa, Artificial Sequence
  Description of Artificial Sequence: Synthetic polypeptide
MPMGSLQPLATLYLLGMLVASVLAAENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNYAPNLLSNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYFGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSIVLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGGGSGS

SEQ ID NO: 477 - protein, 670 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 478 - protein, 672 aa, Artificial Sequence
  Description of Artificial Sequence: Synthetic polypeptide
MRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 479 - protein, 484 aa, Artificial Sequence
  Description of Artificial Sequence: Synthetic polypeptide
MPMGSLQPLATLYLLGMLVASVLAVPVWKEAKTTLFCASDARAYEKKVHNVWATHACVPTDPSPQELVLGNVTENFNMWKNDMVDQMHEDIISLWDQSLKPCVKLTPLCVTLICSNYAPKNLLVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIIIRSENLTNNAKIIIVHLHTPVEIVCTRPNNNTVKSVRIGPGQWFYYFGDIIGDIKMAHCNISEEKWNDTLQKVGIELQKHFPNKTIKYNQSAGGDMEITTHSFNCGGEFFYCNTSNLFNGTYNGTYISTNSSANSTSTIVLQCRIKQIINMWQGVGRAMYAPPIAGNITCRSNITGLLLTRDGGTNSNETETFRPAGGDMRDNWRSELYKYKVVEIQPLGIAPTGAKERVVEREKEGS

SEQ ID NO: 480 - protein, 505 aa, Artificial Sequence
  Description of Artificial Sequence: Synthetic polypeptide
MPMGSLQPLATLYLLGMLVASVLAAENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNYAPNLLSNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYFGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSIVLPCRIKQIINMWQRIGQAMYAPPIQGVIRCVSNITGLILTRDGGSTNSTTETFRPGGGDMRDNWRSELYKYKVVKIEPLGVAPTRCKERVVGREKEGS

SEQ ID NO: 481 - protein, 633 aa, Artificial Sequence
  Description of Artificial Sequence: Synthetic polypeptide
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVQATQTTQDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLW

SEQ ID NO: 482 - protein, 610 aa, Artificial Sequence
  Description of Artificial Sequence: Synthetic polypeptide
MRVRGIQRNCQHLWRWGTLILGMLMICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLQCTNVQVTQTTQNTEEKGEIKNCSFNITTEIRDKKQKVYALFYRLDVVPIDDNNNNSSNYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISGTKWNKTLQQVAKKLREHFNNKTIIFKPSSGGDLEITTHSFNCRGEFFYCNTSGLFNSTWIGNGTKNNNNTNDTITLPCRIKQIINMWQGVGQAMYAPPIEGKITCKSNITGLLLTRDGGNNNTNETEIFRPGGGDMRDNWRSELYKYKVVKIEPLGVAPTKAKLTVQARQLLSGIVQQQSNLLRAIEAQQHLLQLTVWGIKQLQARVLAVERYLKDQQLEIWDNMTWMEWEREINNYTDIIYSLIEESQNQQEKNEQELLALDKWASLWNWFDITNWLW

SEQ ID NO: 483 - protein, 648 aa, Artificial Sequence; identical to SEQ ID NO: 426
  Description of Artificial Sequence: Synthetic polypeptide

SEQ ID NO: 484 - protein, 650 aa, Artificial Sequence; identical to SEQ ID NO: 339
  Description of Artificial Sequence: Synthetic polypeptide

SEQ ID NO: 485 - protein, 652 aa, Artificial Sequence; identical to SEQ ID NO: 345
  Description of Artificial Sequence: Synthetic polypeptide

SEQ ID NO: 486 - protein, 662 aa, Artificial Sequence; identical to SEQ ID NO: 369
  Description of Artificial Sequence: Synthetic polypeptide

SEQ ID NO: 487 - protein, 664 aa, Artificial Sequence; identical to SEQ ID NO: 363
  Description of Artificial Sequence: Synthetic polypeptide

SEQ ID NO: 488 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSNYAPKNLLVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIIIRSENLTNNAKIIIVHLHTPVEIVCTRPNNNTVKSVRIGPGQWFYYFGDIIGDIKMAHCNISEEKWNDTLQKVGIELQKHFPNKTIKYNQSAGGDMEITTHSFNCGGEFFYCNTSNLFNGTYNGTYISTNSSANSTSTIVLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 489 - protein, 648 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCAISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGS

SEQ ID NO: 490 - protein, 648 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNANTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGS

SEQ ID NO: 491 - protein, 648 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGS

SEQ ID NO: 492 - protein, 354 aa, Artificial Sequence
  Description of Artificial Sequence: Synthetic polypeptide
MDAMKRGLCCVLLLCGAVFVSPSASMRHHHHHHVTEHFNMWKNNMVEQMQEDIISLWDQSLKPCVKLTPLCVGSGSCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRPGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIE

SEQ ID NO: 493 - protein, 646 aa, Artificial Sequence; identical to SEQ ID NO: 325
  Description of Artificial Sequence: Synthetic polypeptide

SEQ ID NO: 494 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNANTRKSVRIGPGQTFYATGDIIGDIKQAHCAISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 495 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNANTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 496 - protein, 636 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICGSGCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGS

SEQ ID NO: 497 - protein, 640 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNGSGKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGS

SEQ ID NO: 498 - protein, 644 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATGSGEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGS

SEQ ID NO: 499 - protein, 655 aa, Artificial Sequence
  Description of Artificial Sequence: Synthetic polypeptide
  MOD_RES (317)..(317): Any amino acid
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNDNTRKSVRIGPGQWFYATGDIIGDIKQAHCXHLRGEVERHPAEGGHRAAEALPQQDHQVQPVRRRRHGDHHPLLQLRRRVLLLQHLQPVQRHLQRHLHLHQLLRQLHLHHHPAVPHQADHQHVAGRGPRHVRPPHRRQHHLPLQHHRPAADPRRRHQLQRDRDLPPRRRRHARQLALRAVQVQGGEDRAPGRGPHPLQAPRGGPPPPPPRRGHRRRVPGLPGRRRLHHGRRLHDPDRAGPQPAVRHRAAAVQPAARPRGPAAPAEADRVGHQAAAGPRAGRGALPARPAAAGHLGLLRQADLLHQRALELLLVQPQPVRDLGQHDLAAVGQGDLQLHPDHLRPAGGVPEPAGEERAGPAGPGLVSGRGS

SEQ ID NO: 500 - protein, 670 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNDNTRKSVRIGPGQTFYATGDIIGDIKQAHCTISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 501 - protein, 633 aa, Artificial Sequence
  Description of Artificial Sequence: Synthetic polypeptide
MPMGSLQPLATLYLLGMLVASCLGVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVQATQTTQDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNSNTRKSIHIGPGRAFYTTGEIIGDIRQAHCTISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLW

SEQ ID NO: 502 - protein, 348 aa, Artificial Sequence
  Description of Artificial Sequence: Synthetic polypeptide
MDAMKRGLCCVLLLCGAVFVSPSASMRVTEHFNMWKNNMVEQMQEDIISLWDQSLKPCVKLTPLCVGSGSCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEITCTRPNDNTRPGEIIGDIRQAHCTISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIE

SEQ ID NO: 503 - protein, 634 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICGSGCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 504 - protein, 638 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNGSGKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 505 - protein, 642 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATGSGEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 506 - DNA, 1965 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggatctgcctagcaccggatgatga

SEQ ID NO: 507 - protein, 653 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLPSTG

SEQ ID NO: 508 - DNA, 1992 bp, Artificial Sequence
  Description of Artificial Sequence: Synthetic polynucleotide
atgcccatgggctccctgcagcccctggccaccctgtacctgctgggcatgctggtggcctccgtgctggccggcgggggcgggggcggcgggggcgggggcggcgggggcgggggcgccgagaacctgtgggtgaccgtgtactacggcgtgcccgtgtggaaggaggccaagaccaccctgttctgcgcctccgacgcccgcgcctacgagaaggaggtgcacaacgtgtgggccacccacgcctgcgtgcccaccgacccctccccccaggagctggtgctgggcaacgtgaccgagaacttcaacatgtggaagaacgacatggtggaccagatgcacgaggacatcatctccctgtgggaccagtccctgaagccctgcgtgaagctgacccccctgtgcgtgaccctgatctgctccaacgccaccgtgaagaacggcaccgtggaggagatgaagaactgctccttcaacaccaccaccgagatccgcgacaaggagaagaaggagtacgccctgttctacaagcccgacatcgtgcccctgtccgagaccaacaacacctccgagtaccgcctgatcaactgcaacacctccgcctgcacccaggcctgccccaaggtgaccttcgagcccatccccatccactactgcgcccccgccggctacgccatcctgaagtgcaacgacgagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgcacacccccgtggagatcgtgtgcacccgccccaacaacaacacccgcaagtccgtgcgcatcggccccggccagaccttctacgccaccggcgacatcatcggcgacatcaagcaggcccactgcaacatctccgaggagaagtggaacgacaccctgcagaaggtgggcatcgagctgcagaagcacttccccaacaagaccatcaagtacaaccagtccgccggcggcgacatggagatcaccacccactccttcaactgcggcggcgagttcttctactgcaacacctccaacctgttcaacggcacctacaacggcacctacatctccaccaactcctccgccaactccacctccaccatcaccctgcagtgccgcatcaagcagatcatcaacatgtggcagggcgtgggccgctgcatgtacgccccccccatcgccggcaacatcacctgccgctccaacatcaccggcctgctgctgacccgcgacggcggcaccaactccaacgagaccgagaccttccgccccgccggcggcgacatgcgcgacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 509 - protein, 663 aa, Artificial Sequence
  Description of Artificial Sequence: Synthetic polypeptide
MPMGSLQPLATLYLLGMLVASVLAGGGGGGGGGGGGGGGAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 510 - protein, 4 aa, Artificial Sequence
  Description of Artificial Sequence: Synthetic peptide
GAIA

SEQ ID NO: 511 - protein, 4 aa, Artificial Sequence
  Description of Artificial Sequence: Synthetic peptide
GDIA

SEQ ID NO: 512 - protein, 4 aa, Artificial Sequence
  Description of Artificial Sequence: Synthetic peptide
GAIR

SEQ ID NO: 513 - protein, 4 aa, Artificial Sequence
  Description of Artificial Sequence: Synthetic peptide
ADAR

SEQ ID NO: 514 - protein, 24 aa, Artificial Sequence
  Description of Artificial Sequence: Synthetic peptide
EINCTRPNDNTRPGEIIGDIRQAH

SEQ ID NO: 515 - protein, 6 aa, Artificial Sequence
  Description of Artificial Sequence: Synthetic peptide
CDISRA

SEQ ID NO: 516 - protein, 24 aa, Artificial Sequence
  Description of Artificial Sequence: Synthetic peptide
EINCTRPNNNTRPGEIIGDIRQAH

SEQ ID NO: 517 - protein, 6 aa, Artificial Sequence
  Description of Artificial Sequence: Synthetic peptide
CNISRA

SEQ ID NO: 518 - protein, 18 aa, Artificial Sequence
  Description of Artificial Sequence: Synthetic peptide
YKRWIILGLNKIVRMYSG

SEQ ID NO: 519 - protein, 17 aa, Artificial Sequence
  Description of Artificial Sequence: Synthetic peptide
SYMRVIKNLGLIIWRKY

SEQ ID NO: 520 - protein, 7 aa, Artificial Sequence
  Description of Artificial Sequence: Synthetic peptide
  MOD_RES (3)..(3): Any amino acid
  MOD_RES (6)..(7): Any amino acid
LPXTGXX

SEQ ID NO: 521 - protein, 8 aa, Artificial Sequence
  Description of Artificial Sequence: Synthetic peptide
  MOD_RES (6)..(8): Any amino acid
GGGGGXXX

SEQ ID NO: 522 - protein, 12 aa, Artificial Sequence
  Description of Artificial Sequence: Synthetic peptide
  MOD_RES (3)..(3): Any amino acid
  MOD_RES (10)..(12): Any amino acid
LPXTGGGGGXXX

SEQ ID NO: 523 - protein, 10 aa, Artificial Sequence
  Description of Artificial Sequence: Synthetic peptide
  MOD_RES (1)..(3): Any amino acid
  MOD_RES (6)..(6): Any amino acid
  MOD_RES (9)..(10): Any amino acid
XXXLPXTGXX

SEQ ID NO: 524 - protein, 12 aa, Artificial Sequence
  Description of Artificial Sequence: Synthetic peptide
  MOD_RES (1)..(3): Any amino acid
  MOD_RES (6)..(6): Any amino acid
XXXLPXTGGGGG

SEQ ID NO: 525 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 526 - protein, 648 aa, Artificial Sequence; identical to SEQ ID NO: 426
  Description of Artificial Sequence: Synthetic polypeptide

SEQ ID NO: 527 - protein, 646 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSATVKGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 528 - protein, 851 aa, Human immunodeficiency virus 1
MRVTGILRNYPQWWIWGILGFWMLMTCNGEGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSTATVNNRAVDEMKNCSFNTTTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESKWNETLQKVGIELQKHFPNKTIKYNQSAGGDMEITTHSFNCGGEFFYCNTSKLFNSTYNGTYISTNSTNSTSYITLQCRIKQIINMWQGVGRAMYAPPIAGNITCRSNITGLLLTRDGGINNVSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGHSSLRGLQRGWEVLKYLGSLVQYWGLELKRSAISLFDTLAIAVAEGTDRIIELIQGFCRAIRNIPTRIRQGFEASLL

SEQ ID NO: 529 - DNA, 2577 bp, Human immunodeficiency virus 1
gctagcgccaccatgagagtgacggggatactgaggaattatccacaatggtggatatggggcatcttaggcttttggatgctaatgacttgtaatggggaaggaaacttgtgggtcacagtctactatggggtaccagtatggaaagaagcaaaaactactctgttttgtgcatcagatgccaaagcgtataagaaagaagtgcataatgtctgggcgacacatgcctgtgtacccacagaccccagcccacaagaactgtttttggaaaatgtaacagaaaattttaacatgtggaaaaatgatatggtagatcagatgcatgaggatataatcagtctatgggatcaaagcctaaagccatgtgtaaagttgaccccactctgtgtcactttaatttgtagtactgctactgttaacaatagagcagttgatgaaatgaaaaattgctccttcaatacaaccacagaaataagagataagaaaaagaaggaatatgcacttttttatagatctgatgtagtaccacttgatgaaacaaacaataccagtgagtatagattaataaattgtaatacctcagccgtaacacaagcctgtccaaaggtcacttttgaaccaattcctatacattattgtgctccagctggttatgcgattctaaagtgcaatgatgagacattcaatggaacaggaccatgcagtaatgtcagcacagtacaatgtacacatggaattaggccagtggtatcaacccaactactgttaaatggtagtctggcagaaaaagagatagtaattagatctgaaaacctgacaaacaatgccaaaataataatagtccatcttcacacccctgtagaaattgtgtgtacaaggcccggccataatacaaggaaaagtgtgagaataggcccaggacaaacattctatgcaacaggagacataataggagatataagacaagcacattgtaacattaatgaaagtaaatggaatgaaactttacaaaaggtaggtatagaattgcaaaaacacttccctaataagacaataaagtataaccaatccgcaggaggagacatggaaattacaacacatagctttaattgtggaggagaatttttctattgcaatacatcaaagctgtttaatagtacatacaatggtacatacataagtacaaacagcacaaacagtacttcatacatcacgcttcaatgcagaataaaacaaattataaacatgtggcagggggtaggaagagcaatgtatgctcctcccattgcaggaaacataacatgtagatcaaatatcacagggctactattgacacgtgatggagggatcaataatgttagcaacgagacagagacattcaggcctgcaggaggagatatgagggataattggagaagtgaattatataaatataaagtagtagaagttcagccattaggaatagcaccaactggtgcaaaaaggagagtggtggagagagaaaaaagagcagcaggactaggagctttgttccttgggttcttgggagcagcaggaagcactatgggcgcagcatcaataacgctgacggtacaggccagacaattgttgtctggtatagtgcaacagcaaagcaatttgctgagggctatagaggcgcaacagcatatgttgcaactcacggtctggggcatcaagcagctccaggcaagagtcctggctctggaaagatacctaaaggatcaacagctcctagggatgtggggctgctctggaaaactcatctgcaccactaatgtgccttggaacactagttggagtaataaatctgaaatggatatttggaataacatgacatggatgcagtgggaaagagaaattagcaattacacagagacaatatacatgttgcttgaagactcgcaacgccagcaggagagaaatgaaaaagatttactagcattggacagttggaacagtctgtggaattggtttaacataacaaactggctgtggtatataaaaatattcataatgatagtagggggcttgataggtttaagaatagtttttgctgtgctatctatagtgaatagagtcaggcagggatactcacctttgtcgttgcagacccttaccccaaacccgagggaacccgacaggctcagaggaatcgaagaagaaggtggagagcaagacagagacagatccattcgattagtgagcggattcttgccaattgtctgggacgacctgcggagcctgtgcctcttcagttaccaccgattgagagactttctattgctggcagcgagagtggtggaacttctgggacacagcagtctcaggggactgcagagggggtgggaagtccttaagtatctgggaagtcttgtgcagtattggggtctggaactaaaaaggagtgctattagtctttttgataccctagcaatagcagtagctgaaggaacagataggattatagaattaatacaaggattttgtagagctatccgcaacatacctacaagaataagacaaggctttgaagcatctttgctataatgatctaga

SEQ ID NO: 530 - protein, 647 aa, Human immunodeficiency virus 1
MGSLQPLATLYLLGMLVASVLAAENLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSTATVNNRAVDEMKNCSFNTTTEIRDKKKKEYALFYRSDVVPLDETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESKWNETLQKVGIELQKHFPNKTIKYNQSAGGDMEITTHSFNCGGEFFYCNTSKLFNSTYNGTYISTNSTNSTSYITLQCRIKQIINMWQGVGRCMYAPPIAGNITCRSNITGLLLTRDGGINNVSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 531 - protein, 648 aa, Artificial Sequence
  Description of Artificial Sequence: Synthetic polypeptide
MPMGSLQPLATLYLLGMLVASVLAAENLWVTVYYGVPVWKDAETTLFCASDARAYEKKKRNVWATHCCVPTDPSPQELVLGNVTENFNMWKNDMVDQMHTDIISLWDQSLKPCVKLTPLCVTLICSDATVKTGTVEEMKNCSFNTTTELRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQRVGQAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPECQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 532 - protein, 648 aa, Human immunodeficiency virus 1
MPMGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPISETNNTSEYRLINCNTSACTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSSITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 533 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSAATVKAGTVEEMKNCSFNTTTEIRDKEKKEYALFYKPDIVPISETNNTSEYRLINCNTSACTQACPKVTFEPIPIHYCAPAGYAILKCNNETFNGTGPCTNVSTVQCTHGIRPVVSTQLLLNGSLAEKEIVIRSENLTNNAKIIIVHLNTSVEINCTRPNNNTRKSIRIGPGQTFYATGDIIGDIKQAHCNISEAKWNDTLQNVSIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSSITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 534 - protein, 650 aa, Artificial Sequence
  Description of Artificial Sequence: Synthetic polypeptide
MGSLQPLATLYLLGMLVASCLGVEKLWVTVYYGVPVWKEACTTLFCASDAKAYDTKVRNVWATHCCVPTDPNPQEVVLENVTEHFNMWKNNMVEQMQEDIISLWDQSLKPCVKLTPLCVTLNCKDVKATSTTSDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRWFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEIGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARQLLSGIVQQQNNCLRAPECQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 535 - protein, 651 aa, Artificial Sequence
  Description of Artificial Sequence: Synthetic polypeptide
MGSLQPLATLYLLGMLVASVLAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLDCTNVKVTSTTSNTEEKGEIKNCSFNITTEIRDKKQKVYALFYRLDVVPIDDNNNNSSNYRLINCNTSACTQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISGTKWNKTLQQVAKKLREHFNNKTIIFKPSSGGDLEITTHSFNCRGEFFYCNTSGLFNSTWIGNGTKNNNNTNDTITLPCRIKQIINMWQGVGQCMYAPPIEGKITCKSNITGLLLTRDGGNNNTNETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 536 - protein, 651 aa, Artificial Sequence
  Description of Artificial Sequence: Synthetic polypeptide
MGSLQPLATLYLLGMLVASVLAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTNVNVTSTTSNTEEKGEIKNCSFNITTEIRDKKQKVYALFYRLDVVPIDDNNNNSSNYRLINCNTSACTQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISGTKWNKTLQQVAKKLREHFNNKTIIFKPSSGGDLEITTHSFNCRGEFFYCNTSGLFNSTWIGNGTKNNNNTNDTITLPCRIKQIINMWQGVGQCMYAPPIEGKITCKSNITGLLLTRDGGNNNTNETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 537 - DNA, 1986 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtttggagggacgccgagacaacactgttttgtgcctccgacgccaagggctacgacaccaaggctagaaacgtgtgggccacacactgctgcgtgcccacagatcctagacctcaagagatgtacctggaaaacgtgaccgagaacttcaacatgtggaagaacagcatggtcgagcagatgcacaccgacatcatcagcctgtgggacgagagcctgaagccttgcgtgaagctgacccctctgtgcgtgaccctggattgccaggccttcaatagcagcagccacaccaacagctctatcgccatgcaagagatgaagaactgcagcttcaacgtgaccaccgagctgcgggacaagaagaagaaagagtacagcttcttctacaagaccgacattgagcagatcaacaagaacggccggcagtaccggctgatcaactgcaacacaagcgccatcacacaggcttgccccaaggtgtccttcgagcctattcctatccacttctgtgcccctgccggcttcgccatcctgaagtgcaatgagaagcacttcaacggcaagggcccctgcaagaacgtgtccaccgtgcagtgtacccacggcatcaagccagtggtgtctacccagctgctgctgaatggctctctggccgaagaagaggtggtcatcagagtggaaaacaccatcgacaacgccaagaccatcatcgtgcagctggctaagcccgtgaagatcaattgcacccggcctaacaacaacaccagaaagagcatccggatcggccctggccagtggttttatgccaccggcgatatcatcggcaacatccggaaggcctactgcaatgtgtccaagagagagtggaacaataccctgcagcaggtcgccgctcagctgtccaagtccttcaacaataccaagatcgtgttcgagaagcacagcggaggcgacctggaagtgatcacccacagctttgtgtgtggcggcgagttcttctactgtaacaccagcggcctgttcaactccacctggaccaacagcacctggacaaactctaccaccggcagcaatggcaccgagagcaacgacaccatcactctgcagtgcgagatcaagcagttcatcaatatgtggcagcgcgtcggccaggctatgtacgctcctcctattcctggcgtgatcagatgcgagagcgacatcacaggcctgctgctcacaagagatggccccaatagcacccagaacgagacattcagacctggcggcggagacatgagagacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggcaagaaatctgctgagcggaatcgtccagcagcagagcaacctgctgagagcccctgagtgtcagcagcacctcctgaaactgaccgtgtggggaatcaagcagctgcaggctagagtgctggctgtggaaagatacctgcgggaccagcagctcctcggcatctggggatgttctggcaagctgatctgctgcaccaacgtgccctggaacagctcctggtccaacagaaacctgagcgagatctgggacaacatgacctggctgcagtgggacaaagagatcagcaactacacccagatcatctacggcctgctggaagagagccagaaccagcaagagaaaaacgagcaggacctgctggccctggactgataaggatcc

SEQ ID NO: 538 - DNA, 1968 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtgtggaaggacgccgagacaacactgttttgcgcctccgatgccagagcctacgagaagaaaaagcggaacgtgtgggccacacactgctgcgtgccaaccgatccatctcctcaagagctggtgctgggcaacgtgaccgagaacttcaacatgtggaagaacgacatggtggaccagatgcacaccgacatcatcagcctgtgggaccagagcctgaagccttgcgtgaagctgacccctctgtgcgtgaccctgatctgcagcaatgccaccgtgaagaacggcaccgtggaagagatgaagaactgcagcttcaacaccaccaccgagctgcgcgacaaagagaagaaagagtacgccctgttctacaagcccgacatcgtgcccctgagcgagacaaacaacaccagcgagtaccggctgatcaactgcaacacctccgccgtgacacaggcttgccccaaagtgaccttcgagcccattcctatccactactgtgcccctgccggctacgccatcctgaagtgcaacgacgagacattcaacggcacaggcccctgctccaatgtgtccaccgtgcagtgtacccacggcatcagaccagtggtgtctacccagctgctgctgaatggaagcctggccgagaaagaaatcgtgatcagaagcgagaacctgaccaacaacgccaagatcatcatcgtgcatctgcacacccctgtggaaatcgtgtgcacccggcctaacaacaacacccggaagtctgtgcggatcggccctggccagtggttttatgccaccggcgatatcatcggcgacatcaagcaggcccactgcaacatcagcgaggaaaagtggaacgacaccctgcagaaagtgggcatcgagctgcagaagcacttccccaacaagaccatcaagtacaaccagagcgctggcggcgacatggaaatcaccacacacagcttcaattgtggcggcgagttcttctactgcaataccagcaacctgttcaacgggacctacaatggcacctacatcagcaccaacagcagcgccaactccaccagcaccatcactctgcagtgccggatcaagcagatcatcaatatgtggcagcgcgttggccaggctatgtacgcccctcctatcgccggcaacatcacctgtcggagcaatatcacaggcctgctgctcaccagagatggcggcaccaatagcaacgagacagaaaccttcagacctgccggcggagacatgagagacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcatcgtgcagcagcagagcaatctgctcagagcccctgagtgccagcagcatctgctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaaccggaatctgtccgagatctgggataacatgacctggctgcagtgggacaaagaaatcagcaactacacccagatcatctacggcctgctggaagagagccagaaccagcaagagaaaaacgagcaggacctgctggccctggactgataaggatcc

SEQ ID NO: 539 - DNA, 1986 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtttggagggacgccgagacaacactgttttgtgcctccgacgccaaggcctacgacaccaagaaacggaacgtgtgggccacacactgctgcgtgccaacagaccccaatcctcaagaggtggtcatgggcaacgtgaccgaggacttcaacatgtggaagaacaacatggtcgagcagatgcacaccgacatcatcagcctgtgggaccagagcctgaagccttgcgtgaagctgacccctctgtgtgtgaccctgcactgcaccaatgtgaccatcagcagcaccaatggcagcaccgccaacgtgacaatgcgggaagagatgaagaactgcagcttcaacaccaccaccgtgctgcgggacaagatccagaaagagtacgccctgttctacaagctggacatcgtgcccatcgagggcaagaacaccaacaccggctaccggctgatcaactgcaacaccagcgtgatcacccaggcctgtcctaaggtgtccttcgagcccattcctatccactactgtgcccctgccggcttcgccatcctgaagtgcaacaacaagaccttcaacggcaagggcccctgcagaaacgtgtccaccgtgcagtgtacccacggcatcaagccagtggtgtctacccagctgctgctgaatggctctctggccgaagaggatatcatcatcagaagcgagaacttcaccaacaacgggaagaacatcatcgtgcagctgaaagaacccgtgaagatcaattgcacccggcctggcaacaacacccggcggtctatcaatatcggccctggcagatggttctacgccaccggcgccatcatcggcgatatcagaaaggcccactgcaacatctctaccgagcagtggaacaacacactgacccagatcgtggacaagctgagagagcagttcggcaacaagacgatcatcttcaaccagagcagcggaggcgaccccgaggttgtgatgcacacattcaattgtggcggcgagttcttctactgcaacagcacccagctgttcaactccacctggttcaacaacggcaccagcacctggaatagcaccgccgacaatatcaccctgccttgccggatcaagcaagtgatcaatatgtggcagcgcgtcggccaggctatgtacgcccctcctatcagaggccagatcgactgcagcagcaacatcaccggcctgatcctgacaagagatggcggcagcaactccagccagaacgagacattcagacccggcggaggcaacatgaaggacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcatcgtccagcagcagagcaatctgctcagagcccctgagtgccagcagcatctgctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaacagaaacctgagcgagatctgggacaacatgacctggctgcagtgggacaaagagatcagcaactacacccagatcatctacggcctgctggaagagagccagaaccagcaagagaaaaacgagcaggacctgctggccctggactgataaggatcc

SEQ ID NO: 540 - DNA, 1941 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtttggagggacgccgagacaacactgttttgtgcctccgacgccaaggcctacgagacaaaaaaacgcagcgtgtgggccactcactgctgcgtgccaaccgatcctaatcctcaagagatggtgctggaaaacgtgaccgagaacttcaacatgtggaagaacgacatggtggaccagatgcacaccgacgtgatcagcatctgggaccagagcctgaagccttgcgtgaagctgacccctctgtgcgtgacactggactgcagcacctacaacaacacccacaacatcagcaaagagatgaagatctgcagcttcaatatgaccaccgagctgcgggacaagaaacggaaagtgaacgtgctgttctacaagctggacctggtgcctctgaccaacagcagcaacaccaccaactacagactgatcagctgcaacacctccaccatcacacaggcttgccccaaggtgtccttcgatcccattcctatccactactgtgcccctgccggctacgccatcctgaagtgcaacaacaagaccttcaacggcacaggcccctgcaacaacgtgtccaccgtgcagtgtacccacggcatcaagccagtggtgtctacccagctgctgctgaatggctctctggccgaggaagagatcatcatcagattcgagaacctgaccgacaacgtgaagatcattatcgtgcagctgaacgagacaatcaacatcacatgcacccggccgaacaacaataccagaaagagcatccggatcggccctggccagtggttttatgccaccggcgagatcgtgggcaacatcagagaggcccactgcaatatcagcgccagcaagtggaacaagaccctggaaagagtgcggaccaagctgaaagagcacttccctaacaagaccatcgagttcgagcccagctctggcggcgacctggaaatcaccacacacagctttaactgtggcggcgagttcttctactgtaacaccagcggcctgttcaacagcgccatcaatggcaccctgaccagcaatgtgaccctgccttgccggatcaagcagatcatcaatatgtggcagagagaagtcggccaggctatgtacgcccctcctatcgccggcaacattacctgcaagagcaacatcaccggcctgctgctcaccagagatggcggagagaatagcagctccaccaccgagacattcagacccacaggcggcgacatgaagaacaactggcggagcgagctgtacaagtacaaggtggtcaagatcgagcccctgggcgtcgcaccaacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcattgtgcagcagcagagcaacctgctgagagcccctgagtgtcagcagcacctcctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaacagaaacctgagcgagatctgggataacatgacctggctgcagtgggacaaagagatcagcaactacacccagatcatctacggactgctggaagagagccagaaccagcaagagaaaaacgagcaggacctgctggccctggatggatcc

SEQ ID NO: 541 - DNA, 1977 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtttggagggacgccgagacaacactgttttgtgcctccgacgccaaggcctacgagacaaagaaacggaacgtgtgggccacacactgctgcgtgccaacagaccccaatcctcaagagatccacctggacaacgtgaccgagaagttcaacatgtggaagaacaacatggtcgagcagatgcacaccgacatcatcagcctgtgggaccagagcctgaagccttgcgtgaagctgacccctctgtgtgtgaccctgcactgcaccaatgtgaccagcgtgaacaccaccggcgatagagagggcctgaagaactgcagcttcaacatgaccaccgagctgcgggacaagcggcagaaggtgtacagcctgttctaccggctggacatcgtgcccatcaacgagaatcagggcagcgagtaccggctgatcaactgcaacaccagcgccatcactcaggcctgtcctaaggtgtccttcgagcccattcctatccactactgtacccctgccggcttcgccatcctgaagtgcaaggacgagggcttcaatggcaccggcctgtgcaagaatgtgtccaccgtgcagtgtacccacggcatcaagccagtggtgtctacccagctgctgctgaatggaagcctggccgagaagaacatcaccatcagaagcgagaatatcaccaacaacgccaagatcatcatcgtgcagctggtgcagcccgtgaccatcaagtgcatcagacccaacaacaacacccggaagtccatcagaatcggccctggccagtggttttacgccaccggggatatcatcggcgacatcagacaggcccactgcaacgtgacacggtccagatggaacaagaccctgcaagaggtggccgaaaagctgcggacctacttcggcaacaagaccatcatcttcgccaacagctctggcggcgacctggaaatcaccacacacagcttcaattgtggcggcgagttcttctactgcaatacctccggcctgttcaacagcacttggtacgtgaacagcacctggaacgacaccgacagcacccaagagagcaacgacaccatcacactgccctgccggatcaagcagatcatcaatatgtggcagcgcgcaggccaggctatgtacgctcctcctattcctggcgtgatcaagtgcgagagcaacatcacaggcctgctgctcacaagagatggcggcaaggacaacaacgtgaacgaaaccttcagacccggcggaggcgacatgagagacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcatcgtccagcagcagagcaatctgctcagagcccctgagtgccagcagcatctgctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaacagaaacctgagcgagatctgggacaatatgacctggctgcagtgggacaaagagatcagcaactacacccagatcatctacggcctgctggaagagagccagaaccagcaagagaaaaacgagcaggacctgctggccctggactgataaggatcc

SEQ ID NO: 542 - DNA, 2004 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtttggagggacgccgagacaacactgttttgcgcctccgatgccaaggctcacgagacaaagaaacggaacgtgtgggccacacactgctgcgtgccaacagaccccaatcctcaagagatcgacctggaaaacgtgaccgagaacttcaacatgtggaagaacaacatggtcgagcagatgcagaccgacgtgatcagcctgtgggaccagagcctgaagccttgcgtgaagctgacccctctgtgtgtgaccctgcactgcaccaacgccaatctgaccaaggccaacctgacaaacgtgaacaaccggaccaacgtgtccaacatcatcggcaacatcaccgacgaagtgcggaactgcagcttcaatatgaccaccgagctgcgggacaagaaacagaaggtgcacgccctgttctacaagctggacatcgtgcccatcgaggacaacaacgacaacagcaagtaccggctgatcaactgcaacaccagcgtgatcaagcaggcctgtcctaagatcagcttcgaccccattcctatccactactgcacccctgccggctacgccatcctgaagtgcaacgacaagaatttcaacggcacaggcccctgcaagaacgtgtcctctgtgcagtgtacccacggcatcaagcccgtggtgtctacacagctgctgctgaatggcagcctggccgaggaagagatcatcatcagaagcgaggacctgaccaacaacgccaagaccatcatcgtgcacctgaacaagagcgtggtcatcaattgcacccggcctagcaacaacacccggaccagcatcacaatcggccctggccagtggttctacagaaccggcgatatcatcggagacatccggaaggcctactgcgagatcaatggcaccgagtggaacaaggccctgaagcaagtgacagagaagctgaaagagcacttcaacaacaagcccatcatcttccagcctccatctggcggcgatctggaaatcaccatgcaccacttcaactgcagaggcgagttcttctactgcaataccaccaggctgttcaacaatacctgtatcgccaacggcaccatcgagggctgcaacggcaatatcaccctgccttgcaagattaagcagatcatcaatatgtggcagcgcgcaggccaggctatgtacgcccctcctatcagcggcacaatcaactgcgtgtccaatattaccggcatcctgctgaccagagatggcggagccaccaacaacacaaacaacgagacattcagacccggcggaggaaacatcaaggacaactggcggagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcatcgtgcagcagcagagcaatctgctcagagcccctgagtgccagcagcatctgctgaaactgaccgtgtggggaatcaagcagctgcaggcaagagtgctggctgtggaaagatacctgcgggaccagcagctcctcggcatctggggatgttctggcaagctgatttgctgcaccaatgtgccctggaacagcagctggtccaaccggaatctgagcgagatctgggacaacatgacctggctgcagtgggacaaagagatcagcaactacacccagatcatctacggcctgctggaagagagccagaaccagcaagagaaaaacgagcaggacctgctggccctggatggatcc

SEQ ID NO: 543 - DNA, 1968 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtgtggaaggacgccgagacaacactgttttgcgcctccgatgccagagcctacgagaagaaaaagcggaacgtgtgggccacacactgctgcgtgccaaccgatccatctcctcaagagctggtgctgggcaacgtgaccgagaacttcaacatgtggaagaacgacatggtggaccagatgcacaccgacatcatcagcctgtgggaccagagcctgaagccttgcgtgaagctgacccctctgtgcgtgaccctgatctgcagcgacgccaccgtgaagaccggcaccgtggaagagatgaagaactgcagcttcaacaccaccaccgagctgcgcgacaaagagaagaaagagtacgccctgttctacaagcccgacatcgtgcccctgagcgagacaaacaacaccagcgagtaccggctgatcaactgcaacacctccgccgtgacacaggcttgccccaaagtgaccttcgagcccattcctatccactactgtgcccctgccggctacgccatcctgaagtgcaacgacgagacattcaacggcacaggcccctgctccaatgtgtccaccgtgcagtgtacccacggcatcagaccagtggtgtctacccagctgctgctgaatggaagcctggccgagaaagaaatcgtgatcagaagcgagaacctgaccaacaacgccaagatcatcatcgtgcatctgcacacccctgtggaaatcgtgtgcacccggcctaacaacaacacccggaagtctgtgcggatcggccctggccagtggttttatgccaccggcgatatcatcggcgacatcaagcaggcccactgcaacatcagcgaggaaaagtggaacgacaccctgcagaaagtgggcatcgagctgcagaagcacttccccaacaagaccatcaagtacaaccagagcgctggcggcgacatggaaatcaccacacacagcttcaattgtggcggcgagttcttctactgcaataccagcaacctgttcaacgggacctacaatggcacctacatcagcaccaacagcagcgccaactccaccagcaccatcactctgcagtgccggatcaagcagatcatcaatatgtggcagcgcgttggccaggctatgtacgcccctcctatcgccggcaacatcacctgtcggagcaatatcacaggcctgctgctcaccagagatggcggcaccaatagcaacgagacagaaaccttcagacctgccggcggagacatgagagacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcatcgtgcagcagcagagcaatctgctcagagcccctgagtgccagcagcatctgctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaaccggaatctgtccgagatctgggataacatgacctggctgcagtgggacaaagaaatcagcaactacacccagatcatctacggcctgctggaagagagccagaaccagcaagagaaaaacgagcaggacctgctggccctggactgataaggatcc

SEQ ID NO: 544 - DNA, 1968 bp, Artificial Sequence
  Description of Artificial Sequence: Synthetic polynucleotide
gtcgacgccaccatgcctatgggatctctgcagcctctggccacactgtacctgctgggaatgctggtggcttctgtgctggccgccgagaatctgtgggtcacagtgtactatggcgtgcccgtgtggaaggacgccgagacaacactgttttgcgcctccgatgccagagcctacgagaagaaaaagcggaacgtgtgggccacacactgctgcgtgccaaccgatccatctcctcaagagctggtgctgggcaacgtgaccgagaacttcaacatgtggaagaacgacatggtggaccagatgcacaccgacatcatcagcctgtgggaccagagcctgaagccttgcgtgaagctgacccctctgtgcgtgaccctgatctgcagcaatgccaccgtgaagaacggcaccgtggaagagatgaagaactgcagcttcaacaccaccaccgagctgcgcgacaaagagaagaaagagtacgccctgttctacaagcccgacatcgtgcccctgagcgagacaaacaacaccagcgagtaccggctgatcaactgcaacacctccgccgtgacacaggcttgccccaaagtgaccttcgagcccattcctatccactactgtgcccctgccggctacgccatcctgaagtgcaacgacgagacattcaacggcacaggcccctgctccaatgtgtccaccgtgcagtgtacccacggcatcagaccagtggtgtctacccagctgctgctgaatggaagcctggccgagaaagaaatcgtgatcagaagcgagaacctgaccaacaacgccaagatcatcatcgtgcatctgcacacccctgtggaaatcgtgtgcacccggcctaacgccaacacccggaagtctgtgcggatcggccctggccagtggttttatgccaccggcgatatcatcggcgacatcaagcaggcccactgcaacatcagcgaggaaaagtggaacgacaccctgcagaaagtgggcatcgagctgcagaagcacttccccaacaagaccatcaagtacaaccagagcgctggcggcgacatggaaatcaccacacacagcttcaattgtggcggcgagttcttctactgcaataccagcaacctgttcaacgggacctacaatggcacctacatcagcaccaacagcagcgccaactccaccagcaccatcactctgcagtgccggatcaagcagatcatcaatatgtggcagcgcgttggccaggctatgtacgcccctcctatcgccggcaacatcacctgtcggagcaatatcacaggcctgctgctcaccagagatggcggcaccaatagcaacgagacagaaaccttcagacctgccggcggagacatgagagacaattggagaagcgagctgtacaagtacaaggtggtcaagatcgagcccctgggcgtcgcacctacacggtgcaagagaagagtcgtgggccgtcgtagaaggcggagagccgttggaattggcgccgtgttcctgggctttctgggagccgctggatctacaatgggcgctgccagcatgaccctgacagtgcaggctagaaatctgctgagcggcatcgtgcagcagcagagcaatctgctcagagcccctgagtgccagcagcatctgctgaaactgaccgtgtggggaatcaagcagctgcaggcaagagtgctggctgtggaaagatacctgcgggaccagcagctcctcggcatctggggatgttctggcaagctgatctgctgcaccaacgtgccctggaacagctcctggtccaaccggaatctgtccgagatctgggataacatgacctggctgcagtgggacaaagaaatcagcaactacacccagatcatctacggcctgctggaagagagccagaaccagcaagagaaaaacgagcaggacctgctggccctggactgataaggatcc

SEQ ID NO: 545 - protein, 847 aa, Artificial Sequence
  Description of Artificial Sequence: Synthetic polypeptide
MPMGSLQPLATLYLLGMLVASVLAAENLWVTVYYGVPVWKDAETTLFCASDARAYEKKKRNVWATHCCVPTDPSPQELVLGNVTENFNMWKNDMVDQMHTDIISLWDQSLKPCVKLTPLCVTLICSDATVKTGTVEEMKNCSFNTTTELRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQRVGQAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPECQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 546 - protein, 624 aa, Artificial Sequence
  Description of Artificial Sequence: Synthetic polypeptide
AENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 547 - protein, 624 aa, Artificial Sequence
  Description of Artificial Sequence: Synthetic polypeptide
AENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 548 - protein, 70 aa, Artificial Sequence
  Description of Artificial Sequence: Synthetic polypeptide
MPMGSLQPLATLYLLGMLVASVLAAENLWVTVYYGVPWVKDAETTLFCASDARAYEKKKRNVWATHCCVP

SEQ ID NO: 549 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAITQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 550 - protein, 646 aa, Artificial Sequence
  Description of Artificial Sequence: Synthetic polypeptide
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAITQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGCKRRVVERRRRRRAAGLGALFLGFLGAAGSTMGAASITLTVQARQLLSGIVQQQSNLLRAPEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 551 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 552 - protein, 646 aa, Artificial Sequence
  Description of Artificial Sequence: Synthetic polypeptide
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVEIQPLGIAPTGCKRRVVERRRRRRAAGLGALFLGFLGAAGSTMGAASITLTVQARQLLSGIVQQQSNLLRAPEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 553 - protein, 646 aa, Artificial Sequence
  Description of Artificial Sequence: Synthetic polypeptide
MGSLQPLATLYLLGMLVASVLAAENLWVTVYYGVPVWKDAETTLFCASDARAYEKEKHNVWATHACVPTDPSPQELVLGNVTENFNMWKNDMVDQMHTDIISLWDQSLKPCVKLTPLCVTLICSDATVKTGTVEEMKNCSFNTTTELRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQRVGQCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 554 - protein, 646 aa, Artificial Sequence
  Description of Artificial Sequence: Synthetic polypeptide
MGSLQPLATLYLLGMLVASVLAKGKLWVTVYYGVPVWKDAETTLFCASDARAYEKEKHNVWATHACVPTDPSPQELVLGNVTENFNMWKNDMVDQMHTDIISLWDQSLKPCVKLTPLCVTLICSDATVKTGTVEEMKNCSFNTTTELRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQRVGQCMYAPPIAGNITCRSNITGLLLTRDGGTNSNETETFRPAGGDMRDNWRSELYKYKVVEIQPLGIAPTRCKRRVVERRRRRRAAGLGALFLGFLGAAGSTMGAASITLTVQARQLLSGIVQQQSNLLRAPEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 555 - protein, 646 aa, Artificial Sequence
  Description of Artificial Sequence: Synthetic polypeptide
MGSLQPLATLYLLGMLVASVLAKGNLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIQPLGIAPTRCKRRVVGRRRRRRAVGIGALFLGFLGAAGSTMGAASITLTVQARNLLSGIVQQQSNLLRAPEAQQHLLQLTVWGIKQLQARVLALERYLKDQQLLGIWGCSGKLICCTNVPWNSSWSNKSLSDIWDNMTWLQWDKEISNYTQTIYKLLEDSQNQQEKNEQDLLALD

SEQ ID NO: 556 - protein, 44 aa, Human immunodeficiency virus 1
VEINCTRPNNNTRKSIHIGPGRAFYTTGEIIGDIRQAHCNISRA

SEQ ID NO: 557 - protein, 44 aa, Human immunodeficiency virus 1
VEIVCTRPNNNTRKSVRIGPGQTFYATGDIIGDIKQAHCNISEE

SEQ ID NO: 558 - protein, 44 aa, Human immunodeficiency virus 1
VEIVCTRPGHNTRKSVRIGPGQTFYATGDIIGDIRQAHCNINES

SEQ ID NO: 559 - protein, 65 aa, Human immunodeficiency virus 1
NCTNVNVTNTTNNTEEKGEIKNCSFNITTEIRDKKQKVYALFYRLDVVPIDDNNNNSSNYRLINC

SEQ ID NO: 560 - protein, 65 aa, Human immunodeficiency virus 1
NCKDVNATNTTNDSEGTMERGEIKNCSFNITTSIRDEVQKEYALFYKLDVVPIDNNNTSYRLISC

SEQ ID NO: 561 - protein, 62 aa, Human immunodeficiency virus 1
DCQAFNSSSHTNSSIAMQEMKNCSFNVTTELRDKKKKEYSFFYKTDIEQINKNGRQYRLINC

SEQ ID NO: 562 - protein, 59 aa, Human immunodeficiency virus 1
ICSNATVKNGTVEEMKNCSFNTTTEIRDKEKKEYALFYKPDIVPLSETNNTSEYRLINC

SEQ ID NO: 563 - protein, 65 aa, Artificial Sequence
  Description of Artificial Sequence: Synthetic polypeptide
NCSNVNVTNTTNDSEAEKGEIKNCSFNITTEIRDKKQKEYALFYKLDIVPIDDNNNTSNYRLINC

SEQ ID NO: 564 - protein, 76 aa, Human immunodeficiency virus 1
NCSNATVDSSKVYDTRSNVNVTSINNTIMGEMKNCSFNTTTEIRDKEKKEYALFYRPDVVPLDETSNTSEYRLINC

SEQ ID NO: 565 - protein, 76 aa, Human immunodeficiency virus 1
ICSNATVNNRTAYDTRSNVNVTSINNTIMGEMKNCSFNTTTEIRDKEKKEYALFYKPDIVPLNETSNTSEYRLINC

SEQ ID NO: 566 - protein, 77 aa, Human immunodeficiency virus 1
NCSNATVNNTTDYDSRSNANVTNITNTIKEEVKNCSFKTTTEIRDKEKKEHALFYRPDIVPLNSETGNTSEYRLINC

SEQ ID NO: 567 - protein, 66 aa, Human immunodeficiency virus 1
NCSNARSNVNVTSINNTIMGEMKNCSFNTTTEIRDKEKKEYALFYKPDVVPLNETSNTSEYRLINC

SEQ ID NO: 568 - protein, 60 aa, Human immunodeficiency virus 1
ICSNATVKNSTVEEMKNCSFNTTTEIRDKEKKEYALFYRPDIVPLNNETSNTSEYRLINC

SEQ ID NO: 569 - protein, 72 aa, Artificial Sequence
  Description of Artificial Sequence: Synthetic polypeptide
NCSNATVNYDTRSNVNVTSINNTIMGEMKNCSFNTTTEIRDKEKKEYALFYKPDIVPLNETSNTSEYRLINC

SEQ ID NO: 570 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNDNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 571 - protein, 648 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSNATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 572 - protein, 646 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGRMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 573 - protein, 654 aa, Artificial Sequence
  Description of Artificial Sequence: Synthetic polypeptide
MPMGSLQPLATLYLLGMLVASVLAAENLWVTVYYGVPVWKEAKTTLFCASDARAYEKKVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLPETGG

SEQ ID NO: 574 - protein, 816 aa, Human immunodeficiency virus 1
MPMGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 575 - protein, 652 aa, Artificial Sequence
  Description of Artificial Sequence: Synthetic polypeptide
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLPETGG

SEQ ID NO: 576 - protein, 843 aa, Human immunodeficiency virus 1
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSDATVKTGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 577 - protein, 663 aa, Human immunodeficiency virus 1
MGSLQPLATLYLLGMLVASVLAAENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 578 - protein, 646 aa, Human immunodeficiency virus 1
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGCKRRVVERRRRRRAAGLGALFLGFLGAAGSTMGAASITLTVQARQLLSGIVQQQSNLLRAPEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 579 - protein, 646 aa, Artificial Sequence; identical to SEQ ID NO: 325
  Description of Artificial Sequence: Synthetic polypeptide

SEQ ID NO: 580 - protein, 646 aa, Human immunodeficiency virus 1
MGSLQPLATLYLLGMLVASVLAKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSACTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRCMYAPPIAGNITCRSNITGLLLTRDGGTNSNETETFRPAGGDMRDNWRSELYKYKVVEIQPLGIAPTGCKRRVVERRRRRRAAGLGALFLGFLGAAGSTMGAASITLTVQARQLLSGIVQQQSNLLRAPEAQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 581 - protein, 646 aa, Human immunodeficiency virus 1
MGSLQPLATLYLLGMLVASVLAKGKLWVTVYYGVPVWKDAETTLFCASDARAYEKKKRNVWATHCCVPTDPSPQELVLGNVTENFNMWKNDMVDQMHTDIISLWDQSLKPCVKLTPLCVTLICSNATVKNGTVEEMKNCSFNTTTELRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQWFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQRVGQAMYAPPIAGNITCRSNITGLLLTRDGGTNSNETETFRPAGGDMRDNWRSELYKYKVVEIQPLGIAPTRCKRRVVERRRRRRAAGLGALFLGFLGAAGSTMGAASMTLTVQARNLLSGIVQQQSNLLRAPECQQHMLQLTVWGIKQLQARVLALERYLKDQQLLGMWGCSGKLICCTNVPWNTSWSNKSETDIWDNMTWMQWEREISNYTETIYKLLEDSQNQQERNEQDLLALD

SEQ ID NO: 582 - protein, 648 aa, Artificial Sequence; identical to SEQ ID NO: 531
  Description of Artificial Sequence: Synthetic polypeptide

SEQ ID NO: 583 - protein, 624 aa, Artificial Sequence; identical to SEQ ID NO: 547
  Description of Artificial Sequence: Synthetic polypeptide

What is claimed is:

1. A recombinant HIV-1 envelope polypeptide, comprising all the consecutive amino acids immediately after the signal peptide of HIV-1 envelope CH848.3D0949.10.17, wherein the HIV-1 envelope CH848.3.D0949.10.17 is a gp120 delta 11 envelope comprising SEQ ID NO:328 having non-N-linked glycosylatable amino acids in the V1 loop at positions corresponding to amino acids N133 and/or N138 wherein the amino acid position is with respect to HXB2 envelope sequence, a gp140 envelope comprising SEQ ID NO: 477 having non-N-linked glycosylatable amino acids in the V1 loop at positions corresponding to amino acids N133 and/or N138 wherein the amino acid position is with respect to HXB2 envelope sequence, or a gp160 comprising SEQ ID NO: 327 having non-N-linked glycosylatable amino acids in the V1 loop at positions corresponding to amino acids N133 and/or N138 wherein the amino acid position is with respect to HXB2 envelope sequence.

2. The recombinant HIV-1 envelope polypeptide of claim 1, wherein the HIV-1 envelope CH848.3.D0949.10.17 has non-N-linked glycosylatable amino acids in the V1 loop at positions corresponding to amino acids N133 and N138 wherein the amino acid position is with respect to HXB2 envelope sequence.

3. A nucleic acid encoding any one of the recombinant HIV-1 envelope polypeptides of claim 1 or 2.

4. An immunogenic composition comprising any of the recombinant HIV-1 envelope polypeptides of claim 1 or claim 2 and a carrier.

5. An immunogenic composition comprising the nucleic acid of claim 3 and a carrier.

6. The immunogenic composition of claim 4, further comprising an adjuvant.

7. The nucleic acid of claim 3, wherein the nucleic acid is operably linked to a promoter inserted in an expression vector.

8. A method of inducing an immune response in a subject comprising administering a composition in an amount sufficient to induce an immune response, wherein the composition comprises:

(a) one or more recombinant HIV-1 envelope polypeptides, comprising all the consecutive amino acids immediately after the signal peptide of HIV-1 envelope CH848.3D0949.10.17, wherein the HIV-1 envelope CH848.3D0949.10.17 is a gp120 delta 11 envelope comprising SEQ ID NO: 328 having non-N-linked glycosylatable amino acids in the V1 loop at positions corresponding to the amino acids N133 and/or N138 wherein the amino acid position is with respect to HXB2 envelope sequence, a gp140 envelope comprising SEQ ID NO: 477 having non-N-linked glycosylatable amino acids in the V1 loop at positions corresponding to the amino acids N133 and/or N138 wherein the amino acid position is with respect to HXB2 envelope sequence, a gp160 comprising SEQ ID NO: 327 having non-N-linked glycosylatable amino acids in the V1 loop at positions corresponding to the amino acids N133 and/or N138, a gp140 comprising SEQ ID NO: 525, or a gp140 comprising SEQ ID NO: 574;

(b) one or more nucleic acids encoding any one of the recombinant HIV-1 envelope polypeptides of (a);

c) a combination of one or more of the recombinant HIV-1 envelope polypeptides of (a) and one or more of the nucleic acids of (b); or (d) one or more of the recombinant HIV-1 envelope polypeptides of (a) and/or one or more of the nucleic acids of (b) and a carrier.

9. The method of claim 8, wherein the HIV-1 envelope CH848.3D0949.10.17 is a gp120 delta 11 envelope comprising SEQ ID NO: 328 having non-N-linked glycosylatable amino acids in the V1 loop at positions corresponding to the amino acids N133 and N138 wherein the amino acid position is with respect to HXB2 envelope sequence, a gp140 envelope comprising SEQ ID NO: 477 having non-N-linked glycosylatable amino acids in the V1 loop at positions corresponding to the amino acids N133 and N138 wherein the amino acid position is with respect to HXB2 envelope sequence, a gp160 comprising SEQ ID NO: 327 having non-N-linked glycosylatable amino acids in the V1 loop at positions corresponding to the amino acids N133 and N138.

10. The method of claim 8, wherein the composition is administered as a prime.

11. The method of claim 9, wherein the composition is administered as a prime.

12. The method of claim 8 or 9, wherein the composition further comprises an adjuvant.

13. The method of claim 8 or 9, further comprising administering an agent which modulates host immune tolerance.

14. The method of claim 8 or 9, wherein the recombinant HIV-1 envelope polypeptides of the composition of a), c), or d) are multimerized in a liposome or nanoparticle.

15. The method of claim 8 or 9, further comprising administering one or more additional HIV-1 immunogens to induce a T cell response.

16. The method of claim 10 or 11, wherein a first boost administered after the prime comprises amino acids 25-648 of CH848.3.D0949.10.17CHIM.6R.SOSIP.664V4.1 (SEQ ID NO: 483) or comprises amino acids 25-648 of CH848.3.D0949.10.17chim.6R.DS.SOSIP.664 (SEQ ID NO: 491).

17. The method of claim 10, wherein the prime is a polypeptide comprising all the consecutive amino acids after the signal peptide in CH848.3.D0949.10.17CHIM.6R.SOSIDP.664V4.1_ N133DN138T (SEQ ID NO: 525) comprised in a ferritin nanoparticle or a polypeptide comprising all the consecutive amino acids after the signal peptide in CH848.3.D0949.10.17_DS_ chimeric _SOSIP_ferritin_ N133D_N138T (SEQ ID NO: 574) comprised in a ferritin nanoparticle.

18. The immunogenic composition of claim 5, further comprising an adjuvant.

19. The immunogenic composition of claim 5, wherein the nucleic acid is operably linked to a promoter inserted in an expression vector.

20. The recombinant HIV-1 envelope polypeptide of claim 1, wherein the non-N-linked glycosylatable amino acid in the V1 loop at the position corresponding to N133 is aspartic acid (D) and/or the non-glycosylatable amino acid in the V1 loop at the position corresponding to N138 is threonine (T).

21. The recombinant HIV-1 envelope polypeptide of claim 2, wherein the non-N-linked glycosylatable amino acid in the V1 loop at the position corresponding to N133 is aspartic acid (D) and the non-glycosylatable amino acid in the V1 loop at the position corresponding to N138 is threonine (T).

22. The immunogenic composition of claim 4, wherein the recombinant HIV-1 envelope polypeptides are comprised in a nanoparticle.

23. The immunogenic composition of claim 22, wherein the nanoparticle is a ferritin comprising nanoparticle.

24. An immunogenic composition comprising any of the recombinant HIV-1 envelope polypeptides of claim 20 or 21 and a carrier.

25. A recombinant HIV-1 envelope polypeptide, wherein the HIV-1 envelope polypeptide is a CH848.3.D0949.10.17 gp140 recombinant HIV-1 envelope polypeptide comprising all the consecutive amino acids immediately after the signal peptide of:

CH848.3.D0949.10.17CHIM.6R.SOSIP.664V4.1_N133DN138T (SEQ ID NO: 525), or CH848.3.D0949.10.17 _DS_chimeric _SOSIP_ferritin_N133D_N138T (SEQ ID NO: 574), wherein the CH848.3.D0949.10.17 gp140 recombinant HIV-1 envelope polypeptides form a trimer.

26. The recombinant HIV-1 envelope polypeptide of claim 25, wherein the HIV-1 envelope polypeptide is a CH848.3.D0949.10.17 gp140 recombinant HIV-1 envelope polypeptide comprising all the consecutive amino acids immediately after the signal peptide of CH848.3.D0949.10.17 _DS_chimeric_SOSIP _ferritin_N133D_N138T (SEQ ID NO: 574).

27. The method of claim 14, wherein the nanoparticle is a ferritin comprising nanoparticle.

28. The method of claim 8, wherein the non-N-linked glycosylatable amino acid in the V1 loop at the position corresponding to N133 is aspartic acid (D) and/or the non-glycosylatable amino acid in the V1 loop at the position corresponding to N138 is threonine (T).

29. The method of claim 9, wherein the non-N-linked glycosylatable amino acid in the V1 loop at the position corresponding to N133 is aspartic acid (D) and the non-glycosylatable amino acid in the V1 loop at the position corresponding to N138 is threonine (T).

30. The method of claim 28, wherein the recombinant HIV-1 envelope polypeptide form(s) is administered multiple times.

31. The method of claim 29, wherein the recombinant HIV-1 envelope polypeptide form(s) is administered multiple times.

* * * * *